United States Patent 11,098,302 (IDENTIFICATION OF POLYNUCLEOTIDES ASSOCIATED WITH A SAMPLE) - sequence listing, part 31

SEQ ID NO: 104055 - DNA, 781 bp, Homo sapiens
  misc_feature: GYAE6OF01A6HZS.17.34.D01.1.454.CMB.1.raw
  modified_base (708)..(708): a, c, t, g, unknown or other
  misc_feature (708)..(708): n is a, c, g, or t
  modified_base (714)..(714): a, c, t, g, unknown or other
  misc_feature (714)..(714): n is a, c, g, or t
  modified_base (761)..(761): a, c, t, g, unknown or other
  misc_feature (761)..(761): n is a, c, g, or t
tcagcgtagactagcacgaccggtgctcgatttagatcgtctgtgttgggtttggggatcacaaaacaaccagattcctcctctaaaagaagccccgtgggagcacagctcatcaccatggactggacctggagttcctctttgtggtggcagcagctacaggtgtccagtcccaggtccagttggtgcaatcgtggggctgggagagacgccgtcgtcgtcgtggaggtcgtcctcgcgacgtacgtcgttcggagggccgtaccttaccgtacgacggtaccgttagttaacgtttacgttaacgttagggtttcggggaccggtaccggggtacccggttcccgttagggaaccggtaaaccggtaccggtttcgttagggtacgggtaacggtacggggtaaggggaacgttcccggttaccccgttaccgtttacggttcggttaaacgaacccctaaacccgtaaaacctaacgaccgtactaacggtaaacggtacccgtacgggacgaacgaaccttaccgaacccgtaaccgtaaacccggtaacccggaaacgtaaaacttaaaaccggtaaccaaacgttaacgttaacggttacgtcgggtaaggtacctacgtaaacgaactccgttctacgactacgtcggaaggtaccacggttccgttcttacgtctggtcgacggagtaagtattaactanactccngttccttcctttaaccgtcctccgttgtactacgtcgggtacccganaccgggtacccgtccgtacc

SEQ ID NO: 104056 - DNA, 200 bp, Homo sapiens
  misc_feature: GYAE6OF01B042P.17.34.D01.1.454.CMB.1.raw
  modified_base (176)..(200): a, c, t, g, unknown or other
  misc_feature (176)..(200): n is a, c, g, or t
tcagcgtagactagcacgaccggtgctcgatttagatcgtctgtgttgggtttggggggaagaggaagactgacggccctgctccaggagcacctccgagagcacagcggccctgggctgcctggtcaaggactacttccctagtctacgctgagcgggctggcaaggcgcatagnnnnnnnnnnnnnnnnnnnnnnnnn

SEQ ID NO: 104057 - DNA, 994 bp, Homo sapiens
  misc_feature: GYAE6OF01DN4EW.17.34.D01.1.454.CMB.1.raw
  modified_base (186)..(186): a, c, t, g, unknown or other
  misc_feature (186)..(186): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggngcaatcgtggggctggaggtgaacgaccgccgttgggtcctcgggtaggtacgggtcctccgtggacgaaggtccttcggtagggacggtcctaccgttcgacggtaccgtaacttaacgttagttttacctaaaggtttggggtcggtaccgggtaccgggtcccgttaccggtacgggaaccgtaaaccgggtcctttagggacgggttaggggtaaggtaacggggggaacggttacgttacccggttaccccgttaacgtttaccggttacgtaaaccccgaacccgaaaacccgtaaaaccgtaccgaaccgtaaaccgtaaacggtaaaccggtttacccggaaacgggacccgtaaacgggtaaccccttacccgaaaccccgtaaaacccggttaaaaccccggtaaaccgggtaaaaacccttaaaaaccgtttaaaacccggtaaaaacccgtaaacccggtttaaaagtttaaaccgttaaccggttaacgggtacgtaccgttaaaccggaacccgtaccggtacccgtttacggtacctaacgttaccgtacgggtaaccggaacccggttccggggttaacctttccgttaaccgtttcggttacggtacggtacgggtaaagggttactttaaaccgtttaacttaaacctaaaccgttacgttaccggttttaaccttttaccccgttttaacccttacccccgttttaacctttacccggttaaccgtttacgggttacccgggttacccggtaccggttaaccccgggttaacccccggttaaccccccg

SEQ ID NO: 104058 - DNA, 701 bp, Homo sapiens
  misc_feature: GYAE6OF01B4QZB.17.34.D01.1.454.CMB.1.raw
  modified_base (250)..(250): a, c, t, g, unknown or other
  misc_feature (250)..(250): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacaggtgtccagtcccaggtccagttggtgcaatcgtgggctggaggtgaagcgctgggtcctcggtgacgggtctccgtgacgaaggtcttcgnggacgccacttcgagcgactatagttcaagttgggtgcgacggctcgtggacgaagccgttggagtggtagtacgggaaggactcggtaccctagtcgttacggacaacacctaaactaccgcaacaacggaagttaccgacgggacaacggtaccaccaacctaacgtaacccgacggtaaacaaacgttaaaccgaacaacgtaagttaacgcgttacggagacgtaagaacgtacgtcctacgtacctaatccgtaggaaccgaacgtaccgggtacttacgttaaccttcgtaggtcgtacggtaaggtaacttaacgttaacgtaaactacggtactaccgtatttaccccgtttacctacccttacccggttagtaccctttacgggttaccgggacccttacggtaaccccgggttaaccccgtccgtaccccggttaaccccg

SEQ ID NO: 104059 - DNA, 691 bp, Homo sapiens
  misc_feature: GYAE6OF01CDDVT.17.34.D01.1.454.CMB.1.raw
  modified_base (283)..(283): a, c, t, g, unknown or other
  misc_feature (283)..(283): n is a, c, g, or t
  modified_base (473)..(473): a, c, t, g, unknown or other
  misc_feature (473)..(473): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggtcttcgtggaggcaccttcagcgactatagtctatagtggngacggacgctgagacgacgtcgtgaggtggagagggagtctccgtacctgtcgtacacaccaaccaacgtacgacacgacgtacgtacggagacacactaccaacgaacgtaaccggacgaaactaaacgtaaccgaactaacgtaagttaactacggtagacctaacggtaacaacgtcgtaccgttanacgtattacggaggtaaccgggacgtacccgggtttctttaccgttcgttcggtaggtacggaaggtacggttaaatttaaccgttaacgtaaacttaccgtaccgtttctttaccccgtttttaacccctttaccgtaccccctttcgttaaccgtttaccggttacccgggtacccggtacccttaaaccggggtacccccggttaaaccccccgg

SEQ ID NO: 104060 - DNA, 741 bp, Homo sapiens
  misc_feature: GYAE6OF01CN9QD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctccgtgcgaaggcttcgtggaggcaccttcagcgactatagtttctaagttggtagcggacggcctcgtggacaacggtccttgagtggagtagggagatcgtcctatcgtacgacacaccaaactcgacacacgaagttccgaggcagactaccaccagtaaccggacgaactaagttaaaccgaactaacgtaagttaactacgtaggtaacgtacgtaagaaccgacgtaccgttcgtacgacgttacgtacgggtaacgggaacccgtacgggttccctttaacttaaccgtttcggttcggttacggtacccgggtaaggttaacgtttaaacgtttaccttaaaacgttaaaccgacccgtttaccgttaacccgttttttaccccttttttaaaccgtaaccccccctttttaccgttaccggttttaaacccgttttccgggttaaccggggtaccccttaaaccgggttccccggggtaaaccccccggtttcccccgg

SEQ ID NO: 104061 - DNA, 644 bp, Homo sapiens
  misc_feature: GYAE6OF01DB2Z7.17.34.D01.1.454.CMB.1.raw
  modified_base (362)..(362): a, c, t, g, unknown or other
  misc_feature (362)..(362): n is a, c, g, or t
  modified_base (500)..(500): a, c, t, g, unknown or other
  misc_feature (500)..(500): n is a, c, g, or t
  modified_base (549)..(549): a, c, t, g, unknown or other
  misc_feature (549)..(549): n is a, c, g, or t
  modified_base (562)..(562): a, c, t, g, unknown or other
  misc_feature (562)..(562): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacccgcttaaaccgggacaaccgtccgcccggccaacatacgccttctcccgtcccccttcgcagtaacacaagtacagaatattacctgttccatcgactacgcctttcggcctcgccttaggggtcactcaccctgccccgattaacggttgacacggaaccttggcttccgggngacgtcgggtctttcgacccgtactttactcgttaacttatcgtcacgctactttcgactactttctgtactaccctcagactatacgccctcgaaccagccaactcccttacaacgacggtcttacaacgtaacccncctacccccgtaaccaacaacgcaagtaacgccgtcgtctcgcccgtanacgtcttcgggtnacttgttccggttaccgtccccgtttactccgttcccgttccccgacctacgttacccgaccttacggtccctacggtaccg

SEQ ID NO: 104062 - DNA, 636 bp, Homo sapiens
  misc_feature: GYAE6OF01BOVJT.17.34.D01.1.454.CMB.1.raw
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctggaggtgaagacgccgtgggtcctcggtgagggtctcctgcaaggcttcgnggagccacttcagcgactatagttcaagttggngccgacgggtcctacgtggactaaggtccttggaggtggagtggggaagcgtcgtcctagtcgtgaacacaaccaactcgacaacgagtaacgtcgacggcagcctacaccataacccgagaactaaagtaacaacgtactaagttaatacgagacgtacgtacgaactacgtcctagtctacgtcgtaaggacggaccgtacgggttcttaccgtacgtttcgtaggtcggtaagtacggtaagttaacgtactaacgttaacctaacgttcgttacctttacccgtttacctccctttacctcggtaccgtttacgtccgggtactaccggtacccggtccccgttacccg

SEQ ID NO: 104063 - DNA, 666 bp, Homo sapiens
  misc_feature: GYAE6OF01EHRKY.17.34.D01.1.454.CMB.1.raw
  modified_base (337)..(337): a, c, t, g, unknown or other
  misc_feature (337)..(337): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggtcttcgtgggaggccaccttcgagcgactattacgtttcaagttgggtgcggacgggcctcgtggacgaaggtccgttgagtggagtgggaagntcgtcctagtcgtagacacaaccaactacgcaacgagaactccgagggcagacctcaaccagtaacccgacggaaacaaacgttaaccgaacactaagttaatcgtaggaacgcgtacgaaactacgcccgttagtcctattccgtaggaacggaccgtacgggtcctttacgttaccgtttcgtaggttacggaccggtaaggtaacgttaacttaaccgtaattaacctacgttacggttcccttttacccttttaacctacccctttacccgttagttacccgtttcgtcgtaccggtacctacggttaccccggtaaccccccgg

SEQ ID NO: 104064 - DNA, 909 bp, Homo sapiens
  misc_feature: GYAE6OF01ECL5J.17.34.D01.1.454.CMB.1.raw
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtagaagacgtccgtgggtccgtcgggtgacgggtcctcccgtgaccgaaggtcctttcgtgggacggcctaccctttacgacggtaccgtaacttaagttacgttttaccaaaggtttggggttacggaccgggtaaccgggggtcccttccggtagggtaaccgaaccggggttccccttttagggaagggttacggggaagggttacggggggtaaagggtaccgttcccggtttaccccgttaagtttacccggtttaaggaaccctaaaccctaaacccccgaaaaaaccgttcccggaaccgtaaaccgtaacggtaaacggtttcccggaaacggggtacaaacgggtaaccctaccgtaaaccccgtaacgtaaaaccccgggtaacggaaaaaccttaaaacgtttaaaacccgaaaccgtaacgttaaaacgtttaactaccggtaaggaacgtacgtaacgtaaacgtaacgtcccgtagtaccattccgtagacggaccgtaccggttccttaccgttaacgttcgtagtcgggtacgtaaggttaagttaaacttactaagttaaccctacgttaccgtacccttttacccgttttaaaccctacccctttacggttaccgtaccgtttccgggtaccggtacccttaaacgggtaccccggtaaaccccccggttccgaccccggtttacccccg

SEQ ID NO: 104065 - DNA, 574 bp, Homo sapiens
  misc_feature: GYAE6OF01BZJG6.17.34.D01.1.454.CMB.1.raw
  modified_base (328)..(328): a, c, t, g, unknown or other
  misc_feature (328)..(328): n is a, c, g, or t
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
  modified_base (519)..(519): a, c, t, g, unknown or other
  misc_feature (519)..(519): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctcgtggacaaggtccttggagtggagtgggaagntcgtccctagtcgttgaccacaccaaacgtcgacacagacgttcaggcagactcaccagaaccgcggaactaaacttaacgaacacagttaatcgtagancgagacagtctgcatcgngagacgcggtcttactacgttcgtgtgacgagtagtaactacgtaatactacgtcgtaccttaccctttaacnccttccttcgtaccgttccgtacggtaccctacgttcccggtaaccccgttaccg

SEQ ID NO: 104066 - DNA, 673 bp, Homo sapiens
  misc_feature: GYAE6OF01BPMQF.17.34.D01.1.454.CMB.1.raw
  modified_base (497)..(497): a, c, t, g, unknown or other
  misc_feature (497)..(497): n is a, c, g, or t
  modified_base (538)..(538): a, c, t, g, unknown or other
  misc_feature (538)..(538): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaagtgcccactcccaggtgcagctggtgcagtcgtggggctggaggtgaagagccgtggggcctcagtgaaggtctcctgcaaggcttctggtacttcgacgtttaccctccgtatacgttatccgaacgtggggtacgccgtaccgagggcccgacgttgggaaccaaaccggaccgttgggaacggttgggacgttggggaacgttcggggaccgtaaacccctaacgacgttcgggttgtaccgaactaggttcgttaccttccgaacccctagttcccgaccgggtacacggtacttaccagtcgaacctacgaacctcctaaccaataaaccncgacgtacctaagagtaggattacggagacgtcctagactntcgtgaaccgtacgccgggtccttacttacgttcgagtcgcggtaacgccgtaccccgaggtacgttccgggtagacgaccccgttacgggctaccgggccggttacctttacggaccgtttcgggacccggggg

SEQ ID NO: 104067 - DNA, 647 bp, Homo sapiens
  misc_feature: GYAE6OF01C5IOX.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgccgtgggtcctcggtgagggtctccgtgcaaggtcttcgtggacggcaccttgagcgacttattagtttacaagttgggtgccggacgggcctacgtaggacgaggtccttggagtggagtagggagatccgtcctagtcgttgacaccaccaactacgcacagaactcgaggcagactcaccgactaaccgacgtaactaaattaacgaactactagttaactcgtacggagtacgtaagaactacgtcctagtctacgtcgtaggacggacgacggtcttcgttacttcgtagtcggtacgtaggtaacgttaacttactaagtaacctacgttaccgttacctttacccgtttacctacccctttacccgttacgtaccgtttaccggtaccgggtacctacggtacccggtaaccccggtccgtcccgttacccg

SEQ ID NO: 104068 - DNA, 760 bp, Homo sapiens
  misc_feature: GYAE6OF01CWU6H.17.34.D01.1.454.CMB.1.raw
  modified_base (101)..(101): a, c, t, g, unknown or other
  misc_feature (101)..(101): n is a, c, g, or t
  modified_base (142)..(142): a, c, t, g, unknown or other
  misc_feature (142)..(142): n is a, c, g, or t
  modified_base (187)..(187): a, c, t, g, unknown or other
  misc_feature (187)..(187): n is a, c, g, or t
  modified_base (254)..(254): a, c, t, g, unknown or other
  misc_feature (254)..(254): n is a, c, g, or t
  modified_base (394)..(394): a, c, t, g, unknown or other
  misc_feature (394)..(394): n is a, c, g, or t
tcagcgtagactagcacgaccggtgctcgatttagatcgtctgtgttgggtttggggatcacaaaacaaccagattcctcctctaaagaagcccctgggancacagctcatcaccatggactggacctggagttctctttgnggtggcagcagctacaggtgtccacgtcccgaggtccagttcggnacaatcgtggggctgaggtgaagacgcgtgggtcctcgggtagacggtctctgacgaaggtcttcgngggagcctaccttcgacggcgtaacttagttagtttacgaaggtttggggtcgaccgggtaccgggtccttcggtacggaacgtaaacgggtccttagggaggtgggaaggttaggggaaacggtcttccggttacgttnttacgggtacaaaccgtaaccaacgtaaaccgttacggactaaacgaacggtaacggttacccggaagggtccaacgtaacctaccaaacgaacgtaaccggaacggtaaactaaacgtaaaccgaactaacgttaagttaacgtacgaacggtacgtacgtaacgaacgtacgtccgttacgtaactagttcggaacgtaggaccggttacggtcctttacgttaccgttggtacgtcggaagtaagtacgttaagttaaacctacgtaactacgttccttaaccttttacccgttttaccacccttttacgtcgttacgtccgggttacggtacccgtaaccgttacccgggtaccccgtaccg

SEQ ID NO: 104069 - DNA, 767 bp, Homo sapiens
  misc_feature: GYAE6OF01DPF45.17.34.D01.1.454.CMB.1.raw
tcagcgtagactagcacgaccggtgctcgatttagatcgtctgtgttgggtttggggacaaaacaaccagattcctcctctaaagaaagcccctgggagcacagctcatcaccatggactggacctggaggttcctctttgtggtggcagcagctacaggtgtccagtcccaggtccagttggtgcaatctggggctggaggtgaagacgcctgggtcctcggtgacgggtctcctgcaaggtcttcgtggaggcaccttcgagcgaacttattaacgtttcaagtttggggtcgcggaccgggtcctcgtagggaacgaacgggtccttaggacggttagggagttaggggaaaggacttccgttaccctagttccggttagaaccaaccaaacccaaaactcgacaacaagtaacgttccgaagggcaacgtacctacaacccaagtaaccggacggaaactaaacgttaaacgaacaactaagttaatacgtaggagtactacgaaaccgagtcccgtgactacgtacgtggaaccggtacggtaccgggtctttaccgttaaccttttggcggtacggtaaccgggtaaggttaacgttaacgttaacgttaacttaaaccgtaccgttacgttaccctttttaaccccgtttttaaccctaccccgtttacccgttttcccggtaaccgttttcccgggtacgggtaccccttaaacggttacccccgggtaaaccccccgttccgttaacccccgttcccg

SEQ ID NO: 104070 - DNA, 672 bp, Homo sapiens
  misc_feature: GYAE6OF01CBCA7.17.34.D01.1.454.CMB.1.raw
  modified_base (383)..(383): a, c, t, g, unknown or other
  misc_feature (383)..(383): n is a, c, g, or t
  modified_base (501)..(501): a, c, t, g, unknown or other
  misc_feature (501)..(501): n is a, c, g, or t
tcagcgtagactagcacgaccggtgctcgatttagatcgtctgtggttgggtttgggatcaacaaaacaaccagattccctcctactaaagaacgccccgtgggagcacagctcatccaccagtcggacgtcggaccgtgggtacggtttccttcgtttggtggtggcgagcagctacgtggtcgtccacgtcccgaggtccgtaggttggtgacaagtcgtgggctggaggtagaagcggtccgtcgggtccgtcgggtaggtcgggtctccgtggacgaaggtcttcgtggacggctaccgttcgacgtcgtacttagttagttacgtaagttggggtcgaccggtaccgggtcctcggtaggacgtacggtccgttaggnggttaggacgtagggagtcgtcgtacctagtcgtacacgaacacaactacacaacgagactcgaggcagcacacgacaacgacaacaactacgaactagaatactgagagtcaagtancgtactgacagtcgagagtaccgtcgtacttcgtacttgtgtacgtaagtagtagttaatacgtaacgtacttacgttcgttaccctttacttcccgttccccttacgtttacggttacccgttacgggtacccgtccgtttaaccggtccccggtaccccccggttaccg

SEQ ID NO: 104071 - DNA, 625 bp, Homo sapiens
  misc_feature: GYAE6OF01A9GYW.17.34.D01.1.454.CMB.1.raw
  modified_base (251)..(251): a, c, t, g, unknown or other
  misc_feature (251)..(251): n is a, c, g, or t
  modified_base (368)..(368): a, c, t, g, unknown or other
  misc_feature (368)..(368): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgcctgggtcctcgggtgagggtcctccgtgctaagggcttcngggaggcaccttcagcgactatagtttcaaatttgggtgcgacggggcctcgttggacaaggccttggacggtggagtggggaagatcgtccctatcgttgacacaccaaactacgnacagacgtccagggcagctcacataaccgcgaacaaattaacgaacactaagttaatcgtaggaacgctacgaacacgtaccgtcgtacgtactctaggtacggacgtaccgggtactttcttacgtttcgtacgttcggacggtacggtaagttaacttacgtaaactaactaacgttacgtcctttaccctttttaccaccctttcccttagtacttccggtacgggtaccacgttaccggaccccggttacccg

SEQ ID NO: 104072 - DNA, 541 bp, Homo sapiens
  misc_feature: GYAE6OF01BFVKR.17.34.D01.1.454.CMB.1.raw
  modified_base (494)..(494): a, c, t, g, unknown or other
  misc_feature (494)..(494): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagttcaagttgggtgcgacgggcctcgtggacaaggccttgagtggagtgggaaggatcgtccctagtcgttgacacaccaactacgcacagacgtcagggcagactcacactaccgcgaacaataacgaacacataatctagagctagaacacgctgtcatctgagacgacggtcttctacttctgtgcgagtagtaattactatacatcgtccttactttacncccttccttcgtaccttcgtcggacctacgtccggtaccccgtaccg

SEQ ID NO: 104073 - DNA, 653 bp, Homo sapiens
  misc_feature: GYAE6OF01EEX48.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggtcttcgtggagccaccttcagcgactatagtttcaagttgggtgcggacggcctcgtggacaaggccttggaggtggagtagggaaggtcgtcgtccctattcgttagaacaaccgtaacccaaactacggcaagacgtaacgtccgagggacagactcaaccaataccgacgaactaaactaacgaacactaagttaatcgtaggacgtactagaacacgtcctagtcagtcgtaggaacgacgacggtctttacgtacttcgtgtacgacggtaaggtaacgttaattaactaacgttaaacctacgttcgtaccctttttaccttttacccgtacccctttacccgttcgttaacctttccggtaaccgggtaccctaacggttcccgggtaaacccccggttccccg

SEQ ID NO: 104074 - DNA, 585 bp, Homo sapiens
  misc_feature: GYAE6OF01A8CA4.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctcggtgagggtctcctgcaaggcttcgtgggaggccaccttcagcgactatagttcaagttgggtgcggacggcctctggacaacggccttgagtggagtggggaagcgtcgtccctagtcgttgacacaaccaactacgacacagaacgtccgagggacagactccaaccaacgtaacccgcgaacaaacgtaacgaacaactacgttaactcgtagagactagaacacgtcctgtcatctgacgacgtacggtcttactcgttcgtgtcgcgagtagtaatactatactactgtccttacttttacctccttcccttacgttaccttcgtacgggcctacggtcccggtaccccggtacccg

SEQ ID NO: 104075 - DNA, 810 bp, Homo sapiens
  misc_feature: GYAE6OF01EZHXH.17.34.D01.1.454.CMB.1.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgctgggtcctcggtgaggtctctgcagctgnggagcacctnagcgactatagttcaagttgggngcgacggcctntggacaggccttgagtggagtgggagntcgtcctagtcgtgacacaccaactacgcacgacgtaacgttccgagggcagactacaaccgaataacccgcggaacaaacgttaacgaaactaacgtaacgttaaacttcgtacgggtaacgtacgtacggtaaaaccgtacggacccgtttacggtacccgtagttaccgttaagggaaccgggtacccggtaacccggggttccctttttaacccggttacccgttttaccggttggtttaaccgggtacgggtaaagggttaaaccgttttaaaacgtttaaacccgttaaaacgtttaaacccgtaaacccggtttacggtttaccccgttttttaacccccgtttttttaaacccccgtaaccccccgtttttacccccgttttaacccgggttaaccccgtttttaccccggggtttaaccgggggttaaccccccgtttaacggggtttaaccccccggggtaaaaccccccccggggttttaccccccgg

SEQ ID NO: 104076 - DNA, 595 bp, Homo sapiens
  misc_feature: GYAE6OF01D45G6.17.34.D01.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (448)..(448): a, c, t, g, unknown or other
  misc_feature (448)..(448): n is a, c, g, or t
  modified_base (476)..(476): a, c, t, g, unknown or other
  misc_feature (476)..(476): n is a, c, g, or t
tcagcgtagactagcacgaccggtgctcgatttagatcgtctgtgttgggtttgggatcacaaaacaaccagattcctcctactaaagaagcccctgggagcacagctcatcaccatggactggacctggaggttcctctttggtggtggcagcagctacaggtgtccagtcccaggtccagttggtgcaatcgtggggctgaggtgaagcgccgtggtccgtcggtgnggtctccgtgcgagcttgnggagcacctnagcgtactattgttcagttggngcggacggtctcgtaggacgaacggtcttggagtggtaggtagggaaggtcgtcgtaccctagttcggttacaacgacaacctaaacgtacgacacgaagtaacgtcgaaggcagacctacaccgaagtaccggagaaacaacgtaacgaacataagtatacgtaganacgacacgcgctagcatcgtagacgacncggtcttacgtcgttcgtagtcgagtagtattaatacttactaactcgtcgttacctttacctttactacccttccgttacgttccgttcgtcggtactacgtcccggtacccgtaccg

SEQ ID NO: 104077 - DNA, 724 bp, Homo sapiens
  misc_feature: GYAE6OF01B42ZO.17.34.D01.1.454.CMB.1.raw
tcagcgtagactagcacgaccggtgctcgatttagatcgtctgtgttgggtttggggacaaaacaaccagattcctcctctaaagaagccccctgggagcacagctcatcaccatggactggacctggaggttcctcttttgtggtggcagcagctacaggtgtccagtcccaggtccagttggtgcaatcgtggggctgaggtgaagacgcctgggtcctcggtgagggtctcctgcaaggtcttcgtggcggcaccttcgacgcgtaactatagtttcaagtttggggtcgcggacgggcctcgtaggacaaggccttaggaggtggagtgggaaggctccgtcctagtcgttagacacaccaaactacgacacgagaacgttccgaggcagacctcaaccacgtaaccgacggaacaaaacttaaccgaacactaagttaactcgaggacgaccgtagaactagtacccttagtacctaacgtcgtacggaacgggaaccgtacgggttacctttaccgtaacgtttacgtacggtcggtacgtaagggtaaacgtttaaacttaccttaaaacgtaaccttaccgttacgttaccccgttttttaccccttttaacccgttaccccttaccccggtttacgtacccgttttaccgggtaccggggtacccctaacggtttaccccgggaaaccccccggttctaaccccccgggtttccc

SEQ ID NO: 104078 - DNA, 630 bp, Homo sapiens
  misc_feature: GYAE6OF01A61W0.17.34.D01.1.454.CMB.1.raw
  modified_base (329)..(329): a, c, t, g, unknown or other
  misc_feature (329)..(329): n is a, c, g, or t
tcagcgtagactagcacgaccggtgctcgatttagatcgtctgtgttgggtttggggacaaaacaaccagattcctcctctaaaagaagcccctgggagcacagctcatcaccatggactggacctggaggttcctctttggtggtggcagcagctacaggtgtccagtcccaggtccagttggtgcaatcgtggggctggaggtgaaggacgcctgggtcctggtgagggtctcctgcaaggtcttcgtggaggccaccttcagcgactatagtttcaagttggtgcgacggctcgtggacaaggccttgaggtggagtggggaaggntccgtcctatcgttagaccacaaccaaactacgacacaagtaacgtccgagggcagactacaccagtaaccgacgaacgaaattaacgaactaactaagttaacacgtaggaagactacgaactacgcctagtacatcgtaggacggacgtaccggtctttactacgttctaggtgtacgaaggtaattaactacgtaactaactcttctaccgttttcctttaacctcccttacttccgtacgtttcggtaccggtcctaacgggtcccggaaccccggttcccgtaaccccggttcccg

SEQ ID NO: 104079 - DNA, 686 bp, Homo sapiens
  misc_feature: GYAE6OF01C0RZG.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatcgtggggctgaggtgaagacgccgtgggtcctggtgagggtctcctgcaaggtcttcgtgggacggctaccttcagcgactatagtttcaagttgggtgcgacgggtcctcgtggacgtaaggccttggacggtggagtggggaaggtgtccgtccttagtcgttgaaccacgaaccaaactacgcaacagaactccagggcagactcaacataaccgcgaactaaactaacgaaacactaagttaactacgtaggacgtacagaacctacgccttacgtactacttacgtacggtaacggaccgtacgggtcctttacgttaccgtttctacgggtacgtaccggttaaggtaggttaaactttacgttaaactaacccgttaacgttacggttacccttttacccttttttaaccttaccccgtttacccctttacgttaccttaccggttaccggggtacctaaccggtccgggtaacccccggttaccccgg

SEQ ID NO: 104080 - DNA, 831 bp, Homo sapiens
  misc_feature: GYAE6OF01DDLZ0.17.34.D01.1.454.CMB.1.raw
  modified_base (185)..(185): a, c, t, g, unknown or other
  misc_feature (185)..(185): n is a, c, g, or t
tcagcgtagactagcacgaccggtgctcgatttagatcgtctgtgttgggtttggggatcaacaaaacaaccagattcctcctctaaagaagcccctgggagcacagctcatcacatggactggacctggagttctcttgtggtggcagcagctacgaggtgtccagtcccaggtcctagttggngcaatcgtgggctggaggtagaacggaccgccgtgggtcctcgggtaggacggtcctccgtgacgaacggtcttcggtaggacggtcctaccgttcgacgtacgtaacttagttagtttacaaggtttgggcgccggacggtcctcgtaggaacgtacggttcctggacggtaggacgtaggggaagtcttccggtaccgtagttcggtacaacgtaccgaaacctaaacgtaccgcaaacgacggtaaaccgttccggaaggccaacgtaaccctaacccaaccgtaacgtaacccggaacgtaaacctaaaacgtaacccgaaactaacgttaacgtttaacacggtacggaacgtaccggtaaacgaacgtaaccgtccgttaagtaccgtagttaccgaagggtacggtaaccgtacgggttcttacgttaccgtcgttacggtacgacggtaacgttaagttaacgttaacgtaaacgttacccgtacgttttaacccgttcccgttttaaccccgtttttaacccgtacccccgttttacccggttaaccggtttacccggttttaccggggtaacccccgggtttaaccggttaacccccgggttaaccccggggttaacccccccgggtttaaccccg

SEQ ID NO: 104081 - DNA, 537 bp, Homo sapiens
  misc_feature: GYAE6OF01AU9HR.17.34.D01.1.454.CMB.1.raw
  modified_base (244)..(244): a, c, t, g, unknown or other
  misc_feature (244)..(244): n is a, c, g, or t
  modified_base (482)..(482): a, c, t, g, unknown or other
  misc_feature (482)..(482): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggcaccttcagcgactatagtttcaattgggtgcgacgggcctctggacaaggccttgagtggatgggaaggatcgtccctatcgttgacacaccaaactacgcacagaagttcagggcagactcaccataaccgcggacaaattaacgaacacagttaatcgtaggacgactagaacagcctgtacatctgagacgacggcttctacttctgtgtcgagagtatacgtataacntgtctccttttacacttcctgtacttcgtcggcctataccggacccgtgccgtcc

SEQ ID NO: 104082 - DNA, 741 bp, Homo sapiens
  misc_feature: GYAE6OF01DM1IZ.17.34.D01.1.454.CMB.1.raw
  modified_base (226)..(226): a, c, t, g, unknown or other
  misc_feature (226)..(226): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatcgtgggctggaggtgaagacgccgtgggtcctcggngagggtctcgtgacaggtcttcgtggagcctaccttcgagcgtactattagtttcaagtttgggtagcggaccgggcctcgtggaccaaggtccttaggaggtaggagttaggggaagtacgttccgtcccgttagtcgttagaaccacaacctaactaccgacaacgtaagtaacgttccgaaggtctaagactaccaaccaacgtaaccgacgaactaaacgttaaccgaaactactaacgttaactgtacggactaaccgtacgaaccgacgtaccttacggtactacgttaccgtaggaacggtaacgtacgggttacctttaccttaccgttacgttcgggtacggtaacgtaacgggttaacgtttaaagttaaccgttaataaaccgtacgttaccggtttaccttttaacccctttttaaccctacccgtttaccctttaccggttaaccgttccgggttacccgggtaaccgtacccggttaccggtaaccccccggttaccccgg

SEQ ID NO: 104083 - DNA, 652 bp, Homo sapiens
  misc_feature: GYAE6OF01CM44M.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcgggtgagggtctcctgcaaggcttcgtggagcacctcagcgactatagtttcaagttgggtgcgacgggcctcgtggacaggccgttggagtggagtgggaagatccgtcctatcgttgacacaccaaactcgacacagacgtcgaggacagactcaaccacgtaaccgacgaacaaactaacgaacacaagttaactacgtaggagctacgaacacgcctagtctactcgtagacggacgacggtccttacgttacttcgtggtacggtaggtacggtaacgttaattaccttaataaccgtacttacgttcctttacccgtttttaccctaccccgtttacccgtttcgttaccgttttacccggtacgggtacccgtaaccgggttaccccgggtaaacccccggttcccggttaaccccggttccccg

SEQ ID NO: 104084 - DNA, 711 bp, Homo sapiens
  misc_feature: GYAE6OF01A0W1M.17.34.D01.1.454.CMB.1.raw
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctccgtgcaaggtcttcgtgggacggctaccttcgagccgacttatagtttcaagtttggggtgccggacgggtccttcgtacgggacaacgggtcccgttaggaggtcgggaagtggggaacggtacgttccggttaccctagtcggttacgaccaaccgaaccaaaaccgttccgactaacgaacggtaaacgttcccggaacgggtaccaacggtacctaccgaaacccgtacgtaaacccgggaccggaaaactaaaacgttaaaccgaaacctaacgtaacgtttaaactcgtacggagtacctaagaaccgacgtcctagtactatcgtacggacgacgtacgggtacttcgtacgttcgttggacgtacggagttataacttacgtaactaactacttcgtccgtttacctttactcccgttccttgtacttcggtacggtcctacgtacccggtacccgtcgtccgtacccg

SEQ ID NO: 104085 - DNA, 736 bp, Homo sapiens
  misc_feature: GYAE6OF01EFA4L.17.34.D01.1.454.CMB.1.raw
  modified_base (248)..(248): a, c, t, g, unknown or other
  misc_feature (248)..(248): n is a, c, g, or t
  modified_base (336)..(336): a, c, t, g, unknown or other
  misc_feature (336)..(336): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctctgcaaggcttcgnggagccaccttcagtcgacttattagttacaagttgggtgcggacgggcctcgtggacaaggtccttaggaggtggagtagggaagtntcgtcctagtcgtagacacaaccaactacgacacagtacgtcgaggacacgactacgacctaagtacccgacggtaactaaacgttaacgaacctaacgtaacgttaacgtaccgttacgggaaacgtaccgtaacgtaacccgacgtacccgttacggttaacctacgttccggtaacggtaacgggtaaccgtaaccgggttacctttaccgtttaaccgttccggtaggttacggacggtaaggttaacgttaaacgtttaacgtaaacgttaaccgtaaccgttaccggttcccttttaccctttttaaccccgtaccccgtttcccgtttacggtacccgtttacccggtaccgggtacccttaaccggttccccgggtaaccccggttaccccg

SEQ ID NO: 104086 - DNA, 786 bp, Homo sapiens
  misc_feature: GYAE6OF01E0MPE.17.34.D01.1.454.CMB.1.raw
  modified_base (153)..(153): a, c, t, g, unknown or other
  misc_feature (153)..(153): n is a, c, g, or t
  modified_base (173)..(173): a, c, t, g, unknown or other
  misc_feature (173)..(173): n is a, c, g, or t
  modified_base (550)..(550): a, c, t, g, unknown or other
  misc_feature (550)..(550): n is a, c, g, or t
  modified_base (661)..(661): a, c, t, g, unknown or other
  misc_feature (661)..(661): n is a, c, g, or t
tcagcgtagactagcacgaccggtgctcgatttagatcgtctgtgttgggtttggggatcacaaaacaaccagattcctcctctaaagaagcccctgggagcacagcgtccagtcacactggactaggacctcggtaccgttcctctttcggnggtggcgaggcaggctacgnggtctacagtccagtccagttgtgcaagtcgtgggctggaggtgaagaccgccgtgggttcctcggtggacgggtcctccgtgacgaacggtcttcggtggacggccttaccgttcgagtaccgtacttattacgtttacgaaggtttcgggtcgaccgggtaaccggtcctccgtagggaaccgtaacgggtccgttaggtaaggttcgggaaggtcgggggtaaacgtcgtccggttacccgttaagttcgttacgaacctaaccaaccgtaaacctacgactaacgacgttaacgtccgaaggaccacgtacctacctaaccgaacgtaacccggacgtaaactaaacgtaaaccgaactaacgtaagttaacncgtaacggacgtagtaacggaaactcggtaccctagtaaccgtacgtacgtaacgggacccgaaccggttaccggtctttaccgtacgtttcgtcggtaccggagggttanaacgtttaactacgttaatacccgtattcgttaccccgtttttaccgtttacccacgttttcccgtaaggttaccggtttacccggacgggttaccctacgggttaccccgtaccccgggttccc

SEQ ID NO: 104087 - DNA, 886 bp, Homo sapiens
  misc_feature: GYAE6OF01C0ZHH.17.34.D01.1.454.CMB.1.raw
tcagcgtagactagcacgaccggtgctcgatttagatcgtctgtgttgggtttgggatcacaaaacaaccagattcctcctctaaagaagcccctgggagcacagctcatcaccatggactggacctggagttccttctttggtggtggcagcagctacgaggtgtaccacgtcccaggtccaggttggtgcaatcgtgggctggaggtagaacgtacgccgttggtcctcgggtgaggtcctctggacgtacggcttcgtggacggctaccttcgaacgcgtacttagttagtttacgtaagtttgggtacgacgggaccggtccgttcggtacgggtacgaacgggttaccgttggtaggttcgggaaggttagggggaaagtacgtcccggttacctttaggtaccgttacggaacctaaccgtaaacccgaaaccgttaccggaacctaacggtaaacgtaaaccggttacccgggaaacgggtaccaaccggtacttaacccgaaccgtaaccggttaaccccggaaccggaaactaaaaccgtttaaccgaaccgtaaaccgtagttaaacgtaccggtacggtaacgtacgaacggtaaacccgtacggtaaccttaccgggttacaacgtttaccgtagggtaaccgttaccgggtaaccgggttcctttaccgttacgtttacgtacgtacggttaggtaacggtaagtttaaacgttaacctaacgttaaacccgttagttacccgtttacgtttaacccccgttttttacccgaccccgtttttacccgtttaacccggttacccgttttacccgggtaccgggttaacccttaacccgggttaccccgggtaaccccccgggtttaacccccgg

SEQ ID NO: 104088 - DNA, 869 bp, Homo sapiens
  misc_feature: GYAE6OF01CUDA6.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggtcttcgtggacgcaccttgagcgactatagtttcaagttgggtgccggacgggtcctcgtaggacaaggtcccttggacggtgggagtggggaaaggtactccggtcccttagtcggtttacggaccaaccgaaccctaaaacgtaccgaccaacgaacggtaaaccggtttcccgaacgggggtccaacggtaacctaccgaaaccccgtaacgttaaaacccccgggacgggtaaaaccttaaaaaacgtttaaaacccggaaaccgtaaaccgttaaacggtttaaaccgttaccgttaacggggtaaccggtacccgttaacgggtaaaacccgtaaccggtaccccgtttacggtaacccgttaacgtttaccgtacgggtaaccgggtaacccggtacccggggttactttacccgtttaaccgtttccgttaggttacgtacggtaacggttaacgtttaacttacgtaaacttaaccgtaaccgttacgttacccgtttttacccgtttttaaccctaccccgtttaccccgtttacggttacccgttttaccgggttaccgggtaccccgttaacggttaccccgggtaacccccggttcccgtacccccgtttaccccg

SEQ ID NO: 104089 - DNA, 570 bp, Homo sapiens
  misc_feature: GYAE6OF01EZRXM.17.34.D01.1.454.CMB.1.raw
  modified_base (518)..(518): a, c, t, g, unknown or other
  misc_feature (518)..(518): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtcccagttggtgcaatctggggctgaggtgaagacgcctgggtcctcggtgagggtctcctgcaaggcttctggaggcaccttcagcgactatagtttcaattgggtgcgacgggcctctggacaaggccttgaggtggagtgggaaggatcgtccctagtcgttgactacaccaaactacgcacagaacgttcagggcagactacaccaataaccgcggaacaaattaacgaacacaagttaatactggagactgaacagtcctgctatcgtagacggacgacgggtcttactacttctgtgcgagagttaactatactaacactgtaccttccttttacnccttcccttgtaccctttcgtacgggtacctacgtcggtaaccccgtacccg

SEQ ID NO: 104090 - DNA, 555 bp, Homo sapiens
  misc_feature: GYAE6OF01A4Z0J.17.34.D01.1.454.CMB.1.raw
  modified_base (296)..(296): a, c, t, g, unknown or other
  misc_feature (296)..(296): n is a, c, g, or t
  modified_base (372)..(372): a, c, t, g, unknown or other
  misc_feature (372)..(372): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggacggcaccttcagcgactatagttttcaattgggtgcgacgggcctntggacaaggccttgagtggatgggagatcgtcctatcgtgacacaccaactacgcacagagttccgaggcagtacncaccataaccgcgaactaataacaacactagttaatctaggagctagaacagcctgtacatctgagacacggtcttactacgttctgtgacgaggtacgtatactataacctatcgtcctttactttacccacccttccttctacctttcgtcgggacctacgtccgggtaaccccgttcccg

SEQ ID NO: 104091 - DNA, 777 bp, Homo sapiens
  misc_feature: GYAE6OF01C536X.17.34.D01.1.454.CMB.1.raw
  modified_base (248)..(248): a, c, t, g, unknown or other
  misc_feature (248)..(248): n is a, c, g, or t
tcagcgtagactagcacgaccggtgctcgatttagatcgtctgtgttgggtttggggacaaaaacaaccagattcctcctactaaagaagcccctgggagcacagctcatcaccatggactggacctggaggttcctcttgtggtggcagcagctacaggtgtccagtcccaggtccagttggtgcaatcgtggggctggaggtgaagacgccgtgggtcctggtgagggtctcctgactaggcttgnggagcacttcagcgtacttagtagtttacgaagttggcgcggacggctacgtgacgacggtctggagtaggagtagggaacgtcgtcgtcctagtcgttacgaacctaccgaaacctaaacgtccgaacaacgaacggtaacgttaccggaaggtaccgaacgtacctaccgaaacctaaccggtaaaccggaaccgtaaacgtaaaaacgttaaacccgaaacgtaacgttaaacggtttaactacgggtaggaacgtaccgtaaacggaacgtaccgtccgttactaacggtacttacggaacgggtaccgtaaccggtaccggttaccttttaccgtaccgtttacggtacggttacgggtacggtaaggtaacgttttaaaccttacgtaaacgttaaaccgttaccgttcgtttaaccccttttaccgttttaaccccgtccgtttaacccttacggttaccgttcgggtacgggtaaccctacgggttaacccggtacccccggttctaaacccgggttcccc

SEQ ID NO: 104092 - DNA, 587 bp, Homo sapiens
  misc_feature: GYAE6OF01EM7J0.17.34.D01.1.454.CMB.1.raw
tcagcgtagactagcacgaccggtgctcgatttagatcgtctgtgttgggtttgggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttgagtggagtgggaagatcgtccctatcgtgacacaccaaactcgcacagaacgtccgaggcagactcacataccgacgaactaaataacgaacacaagttaatcgtaggagactagaacagcctgtacatctgagacgacggtcttctacttcgtgtcgacgtaggagttaatacttaataactactagtacctttaccgttttaacctacccttcccttcgttaccgttccgtacgggtaccctagttacccggtaaccccggttccgacccgttcccg

SEQ ID NO: 104093 - DNA, 805 bp, Homo sapiens
  misc_feature: GYAE6OF01DIM2C.17.34.D01.1.454.CMB.1.raw
  modified_base (184)..(184): a, c, t, g, unknown or other
  misc_feature (184)..(184): n is a, c, g, or t
tcagcgtagactagcacgaccggtgctcgatttagatcgtctgtgttgggtttgggacaaaacaaccagattcctcctctaaagaacgcccctgggagcacagctcatcaccatggactggacctggagttcctctttggtggtggcagcagctacaggtgtccagtcccgagtccagttggtncaatcgtgggctggaggtgaagaacgcgtaggggcctcgagtcgaacggtccctgacaggtctcgtgtacttctacgtttacctcgtatagtatactacgtgggtacgccgaccgacggccgtccgtaggaaccgaacggacccgttaggaggtagggagttacggggagtaccggggacccgaaacccttaacgtaccgttacgggtagtaccacgtacggttacgttccttaaccctacccgaaccgttcccggtaccggaaccgtaaacgtaacccgttaacctagtacccgaaacctaacccggtaaaccctcccgtaaccctaaactaaactaacccgtaacgacccttaaaggtacgtaacggtaacgttacgggaacgggtaacgtccgtactaaccgtacgtaacgtaccggtaaccggaaccgtaccggaacccttactttacgttaccttacgtacgtcggaacgggttacgtaacccggtacccggacgttaccgggtaccggtacggtaccggtacccggtaacggaacccggtacggttacccggttccgtttacggttacccgtttaccgggacggggtaccccggtggggtaccccgttcccgggg

SEQ ID NO: 104094 - DNA, 765 bp, Homo sapiens
  misc_feature: GYAE6OF01DYMKY.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttctggaggcaccttcagcgtaactattagtttcaagtttgggtgcggacgggcctcgtggacaaggccttgaggtggagtaggggaaggtatccgtccctatcgttgacacaccaaactcgacacagaacttcgaggacagtactacaccataaccgacgaactaaacgttaacgaactacaagtttaactcgtaggacgtactagaaaccacgtaccttacggtactacgtacttacgggaacggtaaccgtacgggttacctttaccttaacccggtttccgttacgggttaaccgggtaccggttaaacgggtaacggtttaaaacgtttaacccggtttaaacttaaaacccggtaaccgtttaccggttacccctttttaaccccggtttttttaaacccctacccccgttttaccccccgttttaggttaaccccgttttacccgggttacccgggggttaacccctttaaccggggttaacccccgggtaacccccccgggtttaacccccgg

SEQ ID NO: 104095 - DNA, 564 bp, Homo sapiens
  misc_feature: GYAE6OF01EZSJI.17.34.D01.1.454.CMB.1.raw
  modified_base (282)..(282): a, c, t, g, unknown or other
  misc_feature (282)..(282): n is a, c, g, or t
  modified_base (321)..(321): a, c, t, g, unknown or other
  misc_feature (321)..(321): n is a, c, g, or t
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
  modified_base (501)..(501): a, c, t, g, unknown or other
  misc_feature (501)..(501): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaattgggtncgacgggcctctggacaaggccttgagtggatgggaagntcgtcctatcgttgacacgaccaaacgtacgcaacagaagttccagggcagactcacataaccgngaacaatacgaacacattaatctaganctagaacagctgtcatctgacgacacgggcttactacttctgtgacgaggtagtaattactataacactaggtcctttacttttaacncccttcccgttacgtaccgtttccgtacggggaccctacgttccgggtaacccccggttaccg

SEQ ID NO: 104096 - DNA, 729 bp, Homo sapiens
  misc_feature: GYAE6OF01CB0NO.17.34.D01.1.454.CMB.1.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctcttgtggtggcagcagctacaggtgtccacgtcccaggtcctagttggtgcaatcgtgggctgagtgagacgccgtggtccgtcggtgagggtctctgcgagtctgtggacgcaccgtcagcgactatagtttacaagttgggtgcggacggcctcgtggacagggccttggagtggagtgggagntccgtcctatcgttgacactaacaaacgtcgacaacagaacgtccgaggcagacctacaaccacgtaacccgacggaacctaaaagtaaccgaaactacgtaagttaacgtacgacggtaacacgtaagaaccgtacgtcccttagtcctaacgtcgtaggtaaccgggaaccgtacgggttaccctttcgtaaccgtttcgtaggttcgggaacgttaagggtaactttaaacgtttaaaccttaactaaacccggttaacttcccggtttaccctttttacccgtttttaaaccccgttcccccgtttaccgttttaacccgggttacccgtttacccgggttaccggggtaacccctttaaccgggttacccccgggttacccccccgggtttaaccccgg

SEQ ID NO: 104097 - DNA, 863 bp, Homo sapiens
  misc_feature: GYAE6OF01CLC02.17.34.D01.1.454.CMB.1.raw
tcagcgtagactagcacgaccggtgctcgatttagatcgtctgtgttgggtttgggatcacaaaacaaccagattcctcctctaaagaacgcccctgggagcacagctcatcaccatggactggacctgggagttcctctttgtggtggcagcagctacgaggtgtccacgtcccgaggtccaggttggtgcaagtcgtgggcgtggaggtgaagacgtccgtgggtcccgtgggtggtacggtcctccgtgacgaaggtccgttcgtggacggtcctaccgtcgacggacgtacgttaacttaggtttacgtaagttgggtacgcggtaccgggtccgtcgtacggacgtaaccggtccgttggtacggtggtaaggtagggaaggtacgtacccggtaccgttagttccgttacgaacctaccaaccgtaaaccgtacggaaccacgtaaacggtacgttaccggacgtaccgtaacgtaccgtaacccgaaccgtaaccggtaaacccggaccgtaaaccgtaaaacgttaacccgtaaactaaaccgttaacgttactaacgggtacgtaacgtaccgtaaacgaaccgtaccgtaccgttaacgtaccgtaacgttcgtaacggtaaccggtaacccggtaaccggttcctttaaccgttaccgtttaccggttaggtaaccggttaaccggtaaggttaaaaccgttacggtttaaaacctaaaccgtaacgttaccgttaacccggttaccttttaccccgttttaacccttaccccgtttacccttaaccggttaaccgttcccggttaccgggtaacccctacggggttaaccccgcccccgggttaaaccccg

SEQ ID NO: 104098 - DNA, 573 bp, Homo sapiens
  misc_feature: GYAE6OF01EMLUJ.17.34.D01.1.454.CMB.1.raw
  modified_base (323)..(323): a, c, t, g, unknown or other
  misc_feature (323)..(323): n is a, c, g, or t
  modified_base (526)..(526): a, c, t, g, unknown or other
  misc_feature (526)..(526): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccgttcagcgactatagtttcaattgggtgcgacgggcctcgtggacaggccttgagtggatgggaagntcgtcctatcgttgacacaccaaactacgcacagaagttccagggcagactacgaccaataacccgcgaacaaattaacgaacactaagttaatcgtaggacgctagaacgagacctgtcatcgtaggacggacacgggtctttaccgtacttcgtgtcgcggaggtagtaattactaatacctattcgtctttacctttacncccttccttgtaccttcgtacgggacctacgtccggaccccgtaccg

SEQ ID NO: 104099 - DNA, 868 bp, Homo sapiens
  misc_feature: GYAE6OF01EMD4R.17.34.D01.1.454.CMB.1.raw
tcagcgtagactagcacgaccggtgctcgatttagatcgtctgtgttgggttgggatcacaaaacaaccagattcctcctactaaagaagcccctgggagcacagctcatcaccatggactggacctggagtttcctctttgtggtggcagcagctagaggtcgtccagtcccgaggtccagttggtgacaattcgtggggtactggaggtagaagaccgccgtgggtccgtcgggtagcgggttcctccgtgaccgaaggtcttcgtgggacggtcctaccgttacgagtccggtaacttaagtttaacgtttccgtaaaggtttggggtacggtaccggtaccgggtcccttacggtaccggggaaccgtaacggggtacccgtttagggtaaccgggtgggtaaggttacgggggaaacggtacgttccggttaaccccgttagtttaccggttaggaaacctaacccgaaactaaaccgtacgacctaacgaacggtaacgttccgaagggctaaaccggtctaacctaaccgaaccgtaaaccggacggtaaaactaaaaacgttaaccgaaaccgtaaacgttaaacgttaacgtacgttaacggtacgtaacgtaacggtaaaccgtacgtaccttacggttacccgtaacgtacggtacggtaaaccgggttaccgaacgggttacccttacgtttaaccgtttccggttagtacccggtaacgggtaacggtaacgtttaaacgttaccgtaaacttaaccgtacgttccgttacctttacccttttaccctaccgtttacccgttacgttaccgttcggtaaccgtcccgtaaccggtccggtaaccccgggttaccc

SEQ ID NO: 104100 - DNA, 695 bp, Homo sapiens
  misc_feature: GYAE6OF01DM17Y.17.34.D01.1.454.CMB.1.raw
  modified_base (252)..(252): a, c, t, g, unknown or other
  misc_feature (252)..(252): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtgcagcagctacaggtgtccagtcccaggtccagttggtgcaatcgtggggctgaggtgaagacgcctgggtcctcggtgaggtctctgcagcttctggagcacctnacgcgacttatagtttcaagttgggtgcggaccggctcgtggacaaggtcttggagtggagtagggagtntcgtcctagtcgtnacacaaccaaacncgacacaagacgttccgaggacagtaccncaaccagtaacccggacgaaactaaagttaaaccgaactaacgtaagtttaactacggtaggacggtacgtaacgaacgacgtcctagtactattcgtacggaggtacccgtacgggtacctttccgtaacgtttccgtggtacgtacgggttaaggtaacgtttaacttaaactaactaaaccgtaacgttccggttaaccctttttaaccccgttttaacccttaccccgtttacccgtttacggttaacccgtttcccgggttacgggtaaccctttaccggttaaccccgggtacccccggtttaaaccccgg

SEQ ID NO: 104101 - DNA, 824 bp, Homo sapiens
  misc_feature: GYAE6OF01B6Y02.17.34.D01.1.454.CMB.1.raw
tcagcgtagactagcacgaccggtgctcgatttagatcgtctgtgttgggtttggggacaaaaacaaccagattcctcctctaaagaagcccccggagcacagctcatacaccaactggacgtcgtaccgtggaggagtccttccttcgtttggtgggcgagacagactaaccaagtcgcccacctacccgacggtgccagcgtggtgcgagtcgtgggcgtgaggtgaagaagccgtcgggcctcagtggaacgtccttctcggacgagtcgttcgtgggaggacctaccgttcgacgacgtaaccgttattaacgttttaccgtaagtttggggtcggtaccgggccgggtaccctacggtcggaaacggaacgggttcccgttaggtaggtagggtacggtaggggaacggtaccgttacggttcccgttaagttccgttacgaaaccctccgtaaaacccgttaaacgacgacccgtaaacgaaacggttaacgttaccggaacgggtaccgaactaacccgtaccaaacccgtaaacgaaccccgggtaaacgtaaactaaaaccgttaaaccgaaaccgtaacgtaaacgtttaaacgtaccgtaacggaacgtaacgtaacgtaaccgaccgtaccgtacgtactaacgtccggaggaacggtaccgtaccggttacttaccgtacggttatcggtacgtacggagtaacgttattaactaactaacgtacgtccgttaacttacccttttaccgaccctttcccgttacgttaccgttacggtacccgggtacctaccggttacccggtaaccccg

SEQ ID NO: 104102 - DNA, 712 bp, Homo sapiens
  misc_feature: GYAE6OF01BRSOO.17.34.D01.1.454.CMB.1.raw
tcagcgtagactagcacgaccggtgctcgatttagatcgtctgtgttgggttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtctcggtgagggtctcctgcgaaggtcttcgtgggagcaccgttcagcgacttatagtttcaagttggtgacggtacggctcgtggaacaacggtccgttgaggttggagtaggggacggtactcgtaccctagtcgttagaccacgaccaaagtaccgcacgtagacgttcgacgggtcaagtacacaacgaactaaccgacggaaactaaattaaccgaacctaactaacgttaactacgtacggtaacgtacgtaacgaacgtcgtaccgtacggtactattacgtacgggaacgtaccggtacggtctttaccgtaaccgtttcgtcggtacggtaccggtaaggttaacgttaaccttaacgtaagtttaacccgagtttaccttacccgttttaacccttttaccccgcccgtttaccccgttagttaacccgtttccgggtaaccgggtacccctaaggtttccccgggtaaacccccggttacccgg

SEQ ID NO: 104103 - DNA, 617 bp, Homo sapiens
  misc_feature: GYAE6OF01AUK23.17.34.D01.1.454.CMB.1.raw
  modified_base (305)..(305): a, c, t, g, unknown or other
  misc_feature (305)..(305): n is a, c, g, or t
tcagcgtagactagcacgaccggtgctcgatttagatcgtctgtgttgggtttggggagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttggtgcgacgggctctggacaggctgagtggagtgggagntcgtcctatcgttgacacaaccaaactacgacacagaacgttccgaggacagactacacactaaccgcgaactaaactaacgaacaactagttaactcgtaggagactacgaactagccgtagtacactcgtaggacgaccgtcgggtcttactacttctggtgacggtaggtacgttaacttactaacttaactacgttcgtacccttttaccttttaccctacccgttaccgtttcgtaccgtttcggtcgggtacccttacggtacccggtaacccccgtacgtaccccgttctcccgtcgtaaccccg

SEQ ID NO: 104104 - DNA, 557 bp, Homo sapiens
  misc_feature: GYAE6OF01CI0A2.17.34.D01.1.454.CMB.1.raw
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (509)..(509): a, c, t, g, unknown or other
  misc_feature (509)..(509): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgcctgggtcctcggtgagggtctccgtgcaaggcttcgtggacgcaccttnagcgacttatagtttcaagttgggtgcgaccgggccttcgtggacaaggcctttggacggtggatgggaagtntcgtcctagtcgtgacacacaactacgnacagaagtccaggcagactcacanaacgngacaatacaacacataatctgganctagacacgctntacatctaggacgacgacgggtcttcgtacttcgtgtagcggtagattaatactaataacctctagtcctttacctttaaccncccttccttaggtccttcgaccgggtccacgtcggtaaccccgttacc

SEQ ID NO: 104105 - DNA, 864 bp, Homo sapiens
  misc_feature: GYAE6OF01DFPIV.17.34.D01.1.454.CMB.1.raw
tcagcgtagactagcacgaccggtgctcgatttagatcgtctgtgttgggtttggggatcaacaaaacaaccagattcctcctactaaagaagcccctgggagcacagctcatcaccatggactggacctggaggttcctctttgtggtggcagcagctacaggtgtccacgtcccaggtcctagttggtgcaatcgtgggctgaggtgaagcgccgtggtccgtcggtggacggtcctcgtgcgtacggtcttcgtgggacgcctaccttcgacgtcgtaacttacttagtttacgtaaggtttgggcgcggaccggctacgtaggacgaggtccgttggaggtggagtagggaagtctccgtccttagtcgttacgaaccaacgaaccctaaacgtaccgacgaacgtaacggtacgttaccgaggtaccgacgtacctaccaacccgtaacggtaaaccggtaacggtaaactaaaacgttaaccgaactaacgttaacgttacgtacgtacggaacgtacgtaacggaaccgtacgtacgttacgtactacggttacgtacggtaaccgggtaccgtacgggtttacctttaccggttaccgtttacggtacggttacgggtaacgggttaacggttaacgttttaaaccgttaaaccgttaaacgttaaacccgttaaccggttttacccggtttacccctttttaaccccgttttttaacccccgttaaacccccggtttttaccccgtttaacccgggtttaccccggtttaccccggggtttaacccgggggtaaaccccccgttttaccggggttaaacccccccggggttaaccccccgggtttaaccccccgg

SEQ ID NO: 104106 - DNA, 856 bp, Homo sapiens
  misc_feature: GYAE6OF01DVSYX.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatcgtggggctgaggtgaagaccgcctgggtcctcgggtgagggtctccgtgacaggtcttcgtggacggctaccgttcgagacgtaactagttacgtttacgaagttggggtcgaccggtaccgggccttacgtaggaaccgaaagggttccgtttagggaggttggggaaggtagggggtaaacggtacgtcccggttaccccgttaagttaccggtttacgaaccgtaaccaaacccgtaaaaccgtaaccggaccgtaaacgtaaacggtaaccggtttacccggaagggtaccgaacggtaacccttaaccgaaaccccgtaaacgttaaaaccccgggaacgggtaaaacctaaaaacgttaaaaccgtaaaccgtaaaccgttaaacgtttaaacgttaccgttacggaacgtacgttaacgaaacgtacgtaccgtacgtactacgtacgtacggacggtaacggacggttccgttaaaaaccgttcgttacgttggtacggtacgtaaggtaacgttaaacttaacgtaacttaaaccgtacgttaccgttacccttttacccgttttaacccttaccctttacccgtttaccgttaccgtttaccggttaccgggtacccgtaaccggttacccgggtaaccccggttaaccccgg

SEQ ID NO: 104107 - DNA, 733 bp, Homo sapiens
  misc_feature: GYAE6OF01BB4VG.17.34.D01.1.454.CMB.1.raw
  modified_base (239)..(239): a, c, t, g, unknown or other
  misc_feature (239)..(239): n is a, c, g, or t
  modified_base (566)..(566): a, c, t, g, unknown or other
  misc_feature (566)..(566): n is a, c, g, or t
  modified_base (604)..(604): a, c, t, g, unknown or other
  misc_feature (604)..(604): n is a, c, g, or t
tcagcgtagactagcacgaccggtgctcgatttagatcgtctgtgttgggtttggggatcacaaaacaaccagattccctcctactaaaagaacgccccgtgggagcacagctcatcaccagtggactggacctgggaggttcctctttgtggtggcagcagctacaggtgtccagtcccaggtccagttggtgcaatcgtggggactggaggtgacgacgtccgtagggtcctcgggnggtacggtcctccgtgactaagggtcttcgtgggacggcctaccttgacgtccgtaacttagttacggtttactaagttcggggtcgccggtaccgggttcctacggtaggtaccgtaacggccgtttggacggtagggaagttaggggaacgtaccgttccgttacccgttagttaccggttacgaaccgttaaacccaaacgtaaaccgtaccggacctaaacggaacggtaaccgtaccggacgggtacaacgtacctaaccgtaccgaaacgtaacccggaaccggtaaacaaaaccggttaccaaggtaactaaggttaacncggtagtaacgataacgacgacgtactgaccagttcgngacggtacgtcgtcttacgtacttcgagttcgacggtataagtaccttaagataaacccgagtttctaaccctttgttaccctccgtcttacgtaccgttcggacgtaccttcgaccggtacccgtccg

SEQ ID NO: 104108 - DNA, 902 bp, Homo sapiens
  misc_feature: GYAE6OF01DIGQA.17.34.D01.1.454.CMB.1.raw
  modified_base (163)..(163): a, c, t, g, unknown or other
  misc_feature (163)..(163): n is a, c, g, or t
  modified_base (254)..(254): a, c, t, g, unknown or other
  misc_feature (254)..(254): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctgggaggttccttctttggtgggtgcagcagctacnggtgtccagtcccaggtccagttggtgcatcgtgggctgaggtgaacgcgccgtgggtcctcggtgaggtcctccgtgcaaggtctttcgnggacggtcctaccttcgagccgtacttagttacgtttactaaggtttcgggtgaccgggtaccgggtcctcggtaggaaccgtaacgggtccgtttagggtaacggtgggtaaggttacggggggtaaaggtaccgtttcccggttaccccttaggttaccggttaccgaaacctacccgtaaaaccgaaaccttacccggaactaaaccggtaagggtaacccggtttacccggaaacggggaccctaacggttaaccctccccggaaaaacccgtaacggttaaacccccgggaccggtaaaacgttaaaaccgttaaacccgaaaaccgtaaccgtaaaggttttaaacctccgggttaaggtaaccgtaccgtaacgaaacccgtcgtacccggtttagtaccttacgttaccggtacgggaacggttaccggaaccgggtttcctttaaccgttaccggttttcgaggttaccggtacggtaaaggttacggtttaaaacttaccggttaaactaaacccgttccgttaaccgttttcccttttaacccgttttaccgtacccccttttaccggttaccgttaacccggtttcgggtacccgggtaacttccccgggtaccccgggttaccccggtacccccg

SEQ ID NO: 104109 - DNA, 831 bp, Homo sapiens
  misc_feature: GYAE6OF01CMFHK.17.34.D01.1.454.CMB.1.raw
  modified_base (193)..(193): a, c, t, g, unknown or other
  misc_feature (193)..(193): n is a, c, g, or t
tcagcgtagactagcacgaccggtgctcgatttagatcgtctgtgttgggtttggggatcacaaaacaaccagattcctcctactaaagaacgcccctgggagcacagctcatcaccatggactggacctggaggttcctcttggtggtggcagcagctacgaggtcgtccacgtcccaggtcctaggttggngcaagtccggtgggctggaggtgaacgcgccgtgggtccgtgggtggagggtctccgtggacgaaggtcttcggtaggacggtcctaccgttgacgtcgtaacttagttagtttacgtaaggtttcgggtcgaccggaccgggtacctcggtacggaacgtaacgggtccgtttggaggttagggaggtaaggggaacgtacgtccggttaccctaagttccggtacgaaccaacctaaaccgtaaaccgtacgacaacgtaacggtaacgtaccgaacgggcaacgtaccctaccgaacgtaaccgtaacccggacggaaaacctaaacgttaaaccgaacgtaacgttaagttaactcggtaaacggactaaccgtaaacggaacacgttaccccgtagtaaccgtacgttacggtaaggaacccggtacgggtaaccggttcctttaaccgttaccgtttacgggtcgtacggaaacgggttaacgttaagtttaaaccttaaccggttaacttaaaccggttcgttacccggtttaaccttttacccctttaaaccgtacccctttacggttccggttaaccgttccgggaaacgggtccctaaacggtaccccggggtacccccgtttacccg

SEQ ID NO: 104110 - DNA, 555 bp, Homo sapiens
  misc_feature: GYAE6OF01BDH6N.17.34.D01.1.454.CMB.1.raw
  modified_base (257)..(257): a, c, t, g, unknown or other
  misc_feature (257)..(257): n is a, c, g, or t
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
  modified_base (548)..(548): a, c, t, g, unknown or other
  misc_feature (548)..(548): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttnagcgactatagtttcaattgggtgcgacgggcctctggacaaggccttgagtggagtgggaaggatcgtccctatcgttgacacaccaaactacgcacagaagtccaggcagactcaccacgtaaccgcggaacaaattaacgaacactaagttaatcgtggagctagaacagcctgtcatctgagacacgggtcttcgtacttctgtgcgtagactaattactataacactcgtacttccgtttacnccttcccgttnacttcgtcgggtcctagtacggaccccggtcncccgtcc

SEQ ID NO: 104111 - DNA, 671 bp, Homo sapiens
  misc_feature: GYAE6OF01AYG0M.17.34.D01.1.454.CMB.1.raw
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgcctgggtcctcgggtgacgggtctccgtgcgaaggctttcgtgggaggccacctttcaggcgactattacgtttcaaagtttgggtcgcggacgggcctcgtggactaaggtccttggagtggagtggggaaggtatcggtccctagtcgttnaccacaaccaaactacgcaacgagaacgttccgaggcaacgaccncaacgacgtaacccgnggtaaccaaaacttaaccgaactaactaacgttaactacgtaggacgtctaacggaacacgaccgtgtacactctaggacggaaccgacgggtaccttcgttacttcgtcggttcgacggtagtaacgttaattacgtaataaccgtacctcgttacctttcctttttaacccgtaccccttcccgtttacgtaccgtttaccgtacgggtaccctaacggtacccgggtaaccccggttaccccg

SEQ ID NO: 104112 - DNA, 704 bp, Homo sapiens
  misc_feature: GYAE6OF01BIQ01.17.34.D01.1.454.CMB.1.raw
  modified_base (250)..(250): a, c, t, g, unknown or other
  misc_feature (250)..(250): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctggtgagggtctcctgcaaggtcttcgnggacggcctaccttcagtcgacttagttagtttcaagttgggtgcgacgggcctcgtggacgaaggtccgttggaggtggagtaggggaaggtactccggttccctagttcgttacgaacctaacgaaccctaactacgactaacgagtaacgtcgagggacacgactacaacactaaccgacgaactaaataacgaactaacagttaatcgtaggagacgtacgaaactcgaccgttacgtactagtcctaggaacggtaaccgacggttacctttaccgttaccttacgttggtacggtacgtaagggtaacgttaaacgttaaccttaaagtaaccttaacttaccggttccttttacccttttacccgtacccctttaccccgtttacgtacccgttttaccggtacgggttacccggtacggttcccgggtaaacccccggttacccgg

SEQ ID NO: 104113 - DNA, 896 bp, Homo sapiens
  misc_feature: GYAE6OF01EVPZ1.17.34.D01.1.454.CMB.1.raw
  modified_base (139)..(139): a, c, t, g, unknown or other
  misc_feature (139)..(139): n is a, c, g, or t
  modified_base (258)..(258): a, c, t, g, unknown or other
  misc_feature (258)..(258): n is a, c, g, or t
tcagcgtagactagcacgaccggtgctcgatttagatcgtctgtgttgggtttggggatcaacaaaacaaccagattcctcctctaaagaagcccctgggagcacagctcatcaccatggactggacctggagttcctntttgtggtggcagcagctacaggtgtccagtcccaggtccagttggtgcaagtcgtgggctggaggtgaacgcgccgtgggtcctcgggtgacgggtctccgtgacgtacggtcttcgnggacggtcctaccttcgacgtccgtaacttatttacgtttaccgtaaggtttggggtacgtaccggaccggggtccctacggttacgggaaccgtaacgggtcccgttggtaaggggttgggaagggttacgggggaaacgtccggttaccccggtttacccgttaaggtttccggttaacggtaaacccctaacccgtaaaacccgtaaaaccgttaacccggaacgtaaacccggtaaaggttaaacccggtttacccgggaacgggtacccgtaaaggtaccccgttaacccgaaaacccgttaaaccggttaaaccccgggaacccggtaaaaactaaaaaccgttaaacccgaaaaccttaacgtaaacgttttaaaccgtacgggtaacggtaaacgtaccgtaaacgtaaacccgtacgttacccgttacgttaaccgacgtttacgacggtaacggtacgtacccggttactttaccgtacttcggtaggtacgtaacggtaaggtaattaaacttacgtaactaccgtacgttccgttacctttaacccgtttacttaccccttaccgtttaacgtccgttaccggtaacccgggttccgtaaccgttcccgggacccccggttacccg

SEQ ID NO: 104114 - DNA, 775 bp, Homo sapiens
  misc_feature: GYAE6OF01C117E.17.34.D01.1.454.CMB.1.raw
  modified_base (256)..(256): a, c, t, g, unknown or other
  misc_feature (256)..(256): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggaggttctcttgtggtggcagcagctacaggtgtccagtcccaggtccagtggtgcaatcgtggggctgaggtgagacgcctgggtcctggtgtaggtctctgcaaggcttcgtggaggcaccttnagcgaactatagttacagttgggtgtcgacggcctcgtcggacaggccttggagttggagtgggaaggtatcgtcctagtcgttgacgtacaccgtaactacgtcaacgaagtaacgttcgacgggctacggactcgaccactaaccggcgaaacgtaaactaaccgtaactaacgtaacgttaactacgtaggaacgtacgttaacgaacgtacgtaccgttacgtacgtagtaccgttaggaaccgggaaccgtaccggggttacctttaccggtttaccgtttacgtttacgggagttaaccgggtaacggttaacgtttaaaaccgttttaacgttaaaccgttaaaacctacccgggttttaccgttaccgtttttaacccccgttttttaaacccgttaaccccccttttaccccggttttacggttaaccccggttttacccgggttaaccgggggttaccccctaacgggtttaaccccccgggggtaacccccgggtttaaaccccccgg

SEQ ID NO: 104115 - DNA, 652 bp, Homo sapiens
  misc_feature: GYAE6OF01AMAYP.17.34.D01.1.454.CMB.1.raw
  modified_base (354)..(354): a, c, t, g, unknown or other
  misc_feature (354)..(354): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcgggtgagggtcctccgtgcaaggtcttcgtgggacggccaccttcagcgactatagtttcaagttgggtgcggacgggcctcgtggacaaggtccttagagtggagtgggaagctcgtccctagtcgttanacacaccaaactcgcacagaacgtcgagggcacgactcaccagtaacccgcggaaccaaacgttaacgaacaactaagttaactcgtagagctagaacagtcctgtctatcgtaggacgacgtacggtctttaccgtacttgtagtcgacggtaaggtaacgttaagttacgtaacgttaaaccgacgttacggttacctttaccccgtttttaacccaccccgtttccccgtttacggtaccgtttccggttaccggggtaccctaaccggttcccgggtaaccccccggttacccg

SEQ ID NO: 104116 - DNA, 745 bp, Homo sapiens
  misc_feature: GYAE6OF01BKR81.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgcctgggtcctcgggtgagggtctcctgcaaggccttcgtggacggcctaccgttcgagccgacttatagttttaccaagttgggtgcggaccgggtcctcgtggacaaggtccttggaggtggagtggggaaggctccgtcctagtcgttgacaccaacctaactcgacaacagtaacgtccgaggcacgacctacaccgacgtaacccggcgtaaacaaacgttaaacgaactaacgtaagttaactcgtagggaactacctaagaaccacgtaccctgtaccaacttcgacggaacggaccgtacgggtacctttacgtaaccgtttgttacggtacggtacggttaaagggttaaccgtttaagttaaccttaaacgttaacccgtacttaccgttacccctttttaccccgttttaacccgtacccccgtttaccctttgggttaaccccgttttcgggtacccggggttaaccccttaacgggttaacccccgggttaaaccccccggttcccgtaaccccgtttacccccg

SEQ ID NO: 104117 - DNA, 832 bp, Homo sapiens
  misc_feature: GYAE6OF01EG700.17.34.D01.1.454.CMB.1.raw
  modified_base (262)..(262): a, c, t, g, unknown or other
  misc_feature (262)..(262): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtcgtccagtcccaggtccaggttggtgacaagtcgtgggctggaggtgaagacgccgtgggtcctgggtgacgggtctccgtgcgtaacggtctttcgngggacggcctacgttcgaggtcgaacttagttagtttacgaaggtttgggtcgtacggccgggtcctgtacggacgaacggtccgttagagggttggaggtaggggaacgtacgttaccgttccgtacggttcggttacgaaccgaacctaacccgaaacgtaccggtaccgaacgtaaacggtaacgttccggaacgggtaccgtaacggaactacccgaaaccgtaacgttaaaccccgggaccggtaaaacgtaaaactttaaaccggaaacctaaaccgttaacgtttaaacgtacgttaacggaacgtacgtaacgaaccgtacgtcccgttagaccgttactccggtaggtaaccggacgtaccgggttactttactacccgttgtacggtacgaggtaacggttaacgtttaacgtaacgttaaacgttaaccgtacgtttaccgtttaacccttttacccgtttttaacccccgtacccttttaccgttacgtttaacccggtttccggttacccggggttacctaacccggggttaccccggtaaccccgggttacccccg

SEQ ID NO: 104118 - DNA, 770 bp, Homo sapiens
  misc_feature: GYAE6OF01BYOST.17.34.D01.1.454.CMB.1.raw
  modified_base (336)..(336): a, c, t, g, unknown or other
  misc_feature (336)..(336): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaagtcgtggggctggaggtgaagcgccgtgggtcctcggtgagggtctccgtgcaaggcttcgtggacgctaccttcagcgactatagtttcaagttgggtagcggacgggcctacgtggacaaggtccttgagtggagtgggaaggntcgtcctagtcgttagaacacgacaaactaccgcaacaaggtaacgttccgaagggactaacggaaccttaccaaaccgtaaataaaccccgggacgggtaaactaaaaactttaaaccggaaaccaaacgtaacgtttaaactacggttaaggaacgtacgtaacgaaacgaaggtacccttaggtacctaatacggttacggaacgggaaaccgtaccggggttaccctttaacctttaccgttacgttagggttaaccggtaccgggtaaggtaacgttaaacgtttaaactaaatttaaaacccgtaacggttacctccgtttaacccttttttaacccgaccccgttttaccccgttacgttaacccggtttaccggttacggggtaacccctaacggttacccggggtaaacccccggttaaccccgg

SEQ ID NO: 104119 - DNA, 593 bp, Homo sapiens
  misc_feature: GYAE6OF01DNDQR.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgctgggtcctcggtgagggtctctgcaggcttcgtggaggcaccttcagcgactatagtttcaagttgggtgcgacggcctcgtggacaaggtccttgagtggagtgggaagctcgtcctatcgtgacacacaactacgcacagaagtcgaggcagactcacagtacgcgaacaagtaacacacgattaatctagatcgtagaacacgtctagtactagtacgtacggagtaccgacgggtccttacgttacttcgtgtcgacgtaaggtataacgttactaacgtaacctacgtcgttacctttacccgttttaactccctttacccgttagttacccgttcgtacgggtacctacggttacccggtaccccgttacccg

SEQ ID NO: 104120 - DNA, 784 bp, Homo sapiens
  misc_feature: GYAE6OF01C60W5.17.34.D01.1.454.CMB.1.raw
tcagcgtagactagcacgaccggtgctcgatttagatcgtctgtgttgggtttggggatcacaaaacaaccagattcctcctactaaagaagcccctgggagcacagctcatcaaccagtggactggacctggacggttcctctttggtggtggcagcagctacgaggtgccagtcccaggtcctaggttggtgctaagtcgtggggactggaggtgaagcgccgtcgggtcctagggtgagggtcctcgtggacgtaagggtcttacggtgggacggtctaccttagacgacgtacgttattaggtttacgaaggtttgggtacgacgggaccgggtcctacggtaggtaaccgaacgggtccttgggtacggtgggtagtacggggtaaggtacgttacccgttacccgttaagttccggttaaggaaccctaaccgtaaacccgtaaacgtaaccggactaaacggaacggtaaacgtcggaacggacctagaccctacgaaccaacgtaacccggacggtaaacaaactaaacgaactaataacgttaacgtcgtacggatacgtacgtaacgtacctaccgttagaacctagttaccgtaagggacggaaccgtacggttacctttaccgtcgttacggtacggtacgtacggtaaggttacgttaaacttagtaacctaaccgtacgttaccgtaccttttacccttttacccgccctttaccgtacgttacgtttaccggacgggtaccctacgggtaccccggtccccgttacccg

SEQ ID NO: 104121 - DNA, 702 bp, Homo sapiens
  misc_feature: GYAE6OF01AXLOU.17.34.D01.1.454.CMB.1.raw
  modified_base (285)..(285): a, c, t, g, unknown or other
  misc_feature (285)..(285): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgagggtctcctgacaaggcttcgtggaggccaccttcagcgtactatagtttacaagtttgggngcggacggcctcgtaggacaacggtccttggagtcggagtcgggaaggctcgtaccctagtcgttagaccacaaccaactacgcaacgagtacgtccgaggacagacctaccaacgtaactaacccggacggtaaacctaaaagtttaaccgaactaaccgtaacggtttaactacggttaggacgtacgttaacgaacgtacggtacctcgtacagttacgtagggtacggaacggtacggttaccttacttaccgttacggtgtcggaaggtacgttaagttaacttaactaataaccgtactacgttaccctttacctttttacccgacccctttaccgtttacgttaccgttaccggttccgggtacccgtaccggttacccggtaaccccggttccgtacccggttaccccg

SEQ ID NO: 104122 - DNA, 951 bp, Homo sapiens
  misc_feature: GYAE6OF01CSXXD.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctcttgtggtggcagcagctacaggtgtccagtcccaggtccagttggtgcaatcgtggggctgaggtgaagacgccgtgggtcctcgggtgagggtcctccgtgcgaaggtcttcgtgggacggcaccttcgagcgtacttaagtagtttcgaaagtttggggtcgccggaacggggtccctacgtacggaccgaaacggtcctttagggaaggttgggtaagtagggggaaacggtaacttcccgggttaccccttaagttcccggttaaggaaaccaacccgtaaaccgtaaaacctaacggaccaacgaacggtaaacggtttacccgaaggggacctaaaggtaccctaccgaaacccgaacgttaaaacccgggaccgtaaaactaaaaaacgtttaaacccggaaacgaaaccgttaaaggtttaaaccgtacccggttaagggtaacggtacccgtaaacggtaaaacccgtaacgggacccgtttacgggtacctaaaccgttacgggtaaccgggtaaccggggtaaaacccggttacccgggggttaacccctttttaccgttaaacccgtttttcggttaaccggggttaaccggggtaccgggtaaagggttaaacggtttaaacgttttaaacgttaaacttaaacccgttaaaccgttaccggtttaacccttttaaccccttttttaaccggtaccccctttaccccggttttacggttaaccccgtttccgggttaaccgggtaccccgtaacggtttacccggggtaaaccccccttccgggtaccccgtttacccccgg

SEQ ID NO: 104123 - DNA, 855 bp, Homo sapiens
  misc_feature: GYAE6OF01DWC3V.17.34.D01.1.454.CMB.1.raw
  modified_base (251)..(251): a, c, t, g, unknown or other
  misc_feature (251)..(251): n is a, c, g, or t
tcagcgtagactagcacgaccggtgctcgatttagatcgtctgtgttgggtttggggatcacaaaacaaccagattcctcctctaaagaacgccccgtgggagcacagctcatccaccatggactggacctggaggttcctctttgtggtggcagcagctacaggtgtccagtcccaggtccagttggtgcaatctggggctgaggtgaagacgcctgggtcctcggtgaggtcctcctgcaaggcttcgnggagcaccttcagcgtactatagtttcgaagttgggtgcggacgggtcctcgtgggacaacggtcctttggaggtgggagtaggggaaggtattccgttaccctagttccggttagaacctacaaacctaaacgtaccgacgaacctaaggtaaccgttcccggaaacggggtaccaacggtaaccctcccgaaaccgtaaaccgtaaaccccgggtaaccgggaaaccttaaaaacgttaaaccggaaaccctaaccgtaaaggtttaaactacccgttagggtaacgtaaccgttaacggaaaccctaacggtacccttacggtacctaaggttacccgttaagggtaacgggtaaccggtaaccggggttacccttttacccgttaaccgtttccgttagggttacggtaccgggtaaagggttaacggttaaacttttaacccttaaaacgttaacccgtaaccgttaccggttaccccgtttttaccccttttttaacccggtaacccctttacccccgttttcggttaaacccgttttccgggtaaccggggttaccccttaacggttacccccggggtaaccccccggttaccccgg

SEQ ID NO: 104124 - DNA, 809 bp, Homo sapiens
  misc_feature: GYAE6OF01DBEVO.17.34.D01.1.454.CMB.1.raw
  modified_base (139)..(139): a, c, t, g, unknown or other
  misc_feature (139)..(139): n is a, c, g, or t
  modified_base (186)..(186): a, c, t, g, unknown or other
  misc_feature (186)..(186): n is a, c, g, or t
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
  modified_base (716)..(716): a, c, t, g, unknown or other
  misc_feature (716)..(716): n is a, c, g, or t
tcagcgtagactagcacgaccggtgctcgatttagatcgtctgtgttgggtttgggacaaaacaaccagattcctcctctaaagaacgcccctgggagcacagctcatcaccatggactggacctggagttcctcttgnggtggcagcagctacgaggtcgtccacgtcccaggtcctaggttggnctaatcgtggggactgaggtgaagccggtccggtcggtccgtggnggtacggtcctcgcgacgtacgttccgtggaggacgtcccgtacncgacgactaacgttaagttacgttagtaggttcggacggtccggacgtcgtagacggtaacgtaggtccgttaggaggtaggtacggtaacggaacgttccgtaccggttaccgttacgttaccgggtaaccgaaaccaaccccgtaaaaccgtaaccgtacaccggtaaacgtaaacggttaaccggttaccgggaaacgaaccgtaaccgtaccgtaaacccgaaaacgttacccgggaaaacccggtaagaaaaccgttaaaacgtaaaccgtaacgtaaacgttaacgttaaccggagtaacgaacgtaccgtaaacggtaccgtcgtacgttaccgtacgtaacgttacggaacggtaccgtaaaccggttacggttccttaacgttcgtacgttcgacggtaacgtaagttacttaacgtaactaacgtaactnttaccgttaaccttttaccgtaccttaccgttcctaggtccgttaccgggtactacccggacgtaccccggttaacctccgtcccgttacccg

SEQ ID NO: 104125 - DNA, 732 bp, Homo sapiens
  misc_feature: GYAE6OF01B45FD.17.34.D01.1.454.CMB.1.raw
  modified_base (165)..(165): a, c, t, g, unknown or other
  misc_feature (165)..(165): n is a, c, g, or t
  modified_base (250)..(250): a, c, t, g, unknown or other
  misc_feature (250)..(250): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtntccagtcccaggtccagttggtgcaatcgtggggctgaggtgaagcgccgtgggtcctcggtgacgggtctcgtgcaggcttcgnggagccaccgttcagcgtacttatagtttcaagttgggtagccggacgggtcctcgtaggacaggccttggacgtggagtggggaagtgtccgtccctagtcggttagaacaccgaaccaaactcgactaacgaagtaacgttccgacgggtccaacgtaccgtacgaacccgtaacggtaaacccggacggtaaactaaaacgttaaccgaaacgtaaccgtaagtttaactacgtacggactacgtacgaacgacgtacctacgtacactcgtagacggacgtacggtccttaccgttacgttcgtacggtcggacggtaacggtaacgttaaacgttaaccgttaaagtaaacccttagttcggtttaccctttaacccgtttttaacccctacccccgttttccgttaaccggttacccgttttacccgggtcgggtaaccctacgggttaccccgggtaacccccggttaccccggg

SEQ ID NO: 104126 - DNA, 555 bp, Homo sapiens
  misc_feature: GYAE6OF01BHPXW.17.34.D01.1.454.CMB.1.raw
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctntggacaaggccttgaggtggatgggaagatccgtcctatcgttgacacaccaactcncaacagaagttcaggcagactcacataccgngacaaattacgacacatancngagtnagacagctgtcatctgaggacacggtcttctacttctgtgcgaggtataattactaataacactactcctttaccttttacacccttacccgtttgtacctttcggtcgggtacctacgtaccgggtaccccgttccgtcccggttccc

SEQ ID NO: 104127 - DNA, 751 bp, Homo sapiens
  misc_feature: GYAE6OF01AZSL7.17.34.D01.1.454.CMB.1.raw
  modified_base (205)..(205): a, c, t, g, unknown or other
  misc_feature (205)..(205): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtnaagacgcctgggtcctcggtgacgggtctcctgcaacggtcttcgtgggacggcctaccgttcgacgtccgtacttattaagtttccaaagtttgggacggcggacgggtccttcgtggaaccctaagggtcccgtttaggacggttggaacggttaggggaagggtactccggttaccccgtattccgggtttacgaaccgtaaccgaaaccctaaaaccgtaccgacgaaacgtaacggaacggttcccgaagggaccgtacgacctaccaaccgaacgtacccggacgaaactaaacgttaaccgaacgaactaacgttaacgtaccgtaggaactacgtaacgtaaccacgtaccgtgtacctagtacctaggacggaaccgtacgggtctttaccgtacgttcgtagtacggaccgtaaggtacgttaacttactaacgtaactacgtacgtaccctttacccgttttacccaccttaccccgttactacccgtttcggtacgggtacccgtaccggttacccggtaacccccgttacccg

SEQ ID NO: 104128 - DNA, 611 bp, Homo sapiens
  misc_feature: GYAE6OF01DVDV7.17.34.D01.1.454.CMB.1.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcnggaggcaccttcagcgactatagtttcaagttgggtgcgacggcctntggacaaggccttgagtggagtgggaaggatcgtccctatcgtgacacacaactcgcacagacgttcgaggcagactacacactaaccgcggaacaattaacgaacactaataatctaggacgctagaacagctacgtacatcgtcgaagaccgtacgggtcttacgtacttcgtgtagtacggaagtacgttaaacttacgtaactaacctagtacgttcccttttacctttttaccctaccctttaccccgttacgtaacccgtttccggtacgggtaccctacggttacccgggtaacccccggttaccccgg

SEQ ID NO: 104129 - DNA, 803 bp, Homo sapiens
  misc_feature: GYAE6OF01DKFCN.17.34.D01.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggagttctctttgtggtgcagcagctacaggtgtccagtcccaggtccagttgtgcaatcgtgggctgaggtgaagcgccgtgggtcctcgggtgacggttcnccgtgacgaaggtcttcgngggacgcctaccgttcgacgcgtaacttagttacgtttacaagtttgggtacgacggaccgggtcctaccgtggaacgtaacggtccgttaggaggttggagtacgggaagtacgtccgttaccctagttcgtacgtaaccaacctaaccgaaactcgaaccgaaacgtaaggtaaccgttaccgaacgggactaacgtaaccctacaaaccgtaaacgtaacccggacggtaaaactaaacgttaaaccgaaactaacgttaaagttaacgtacgtaggaacgtacgtaacgaaccgtacgtaccgttacgtacctaacgtccgtaaggaccgtaacggaccggttacctttaccgttaccgttacggtggttacggtaacggttaaggttaacttaattaacgttaaacgtacccgttacggttaccgtttaacccctttaccccgtttttaacctacccccgtttcccgtttaccgttacccgtttccgggtaacccgggtacccttaaacccgggtttacccccgggtaacccccggtttaaccccgg

SEQ ID NO: 104130 - DNA, 856 bp, Homo sapiens
  misc_feature: GYAE6OF01D3A00.17.34.D01.1.454.CMB.1.raw
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtccgtcggtggagggtcctcctgcgaaggtcttcgtggaggcctaccgttcgagcgtaactattaacgtttcgaaagtttggggtagcggaaccggggtccttacgttgggaaccgtaagggcccgtttaggaaggttgggaagttacgggggaacggtacgttccggttacccctaagttcccggtttaagaaccgtaacctaaaccccgaaaacgttacccgaacctaaccgaaacggttaaaccgtttaccccgaaggggtaccctaagggtaaacccttaccgaaccccgtaaagttaaaccccgggaaccgggtaaaaaccgtaaaaacgtttaaaacccggaaaccgtaaaccgtaaacggtttaaacttaccggttagggaacgtaccgttacggaaaaccgtacgtaccccgtagttcgtaacttcggtaagtacggaaccggtaacggtcctttactaccgtttacgtggtacgtaccggtaagggttaacgttaatttacccgtaaataaccgtaacgtttccgtacccttttaccttttaaccctccctttaccccgttagttacccgtttaccgtaccggggtaccttaaacggttcccggtaaacccccggttccgtcccgtaccccg

SEQ ID NO: 104131 - DNA, 934 bp, Homo sapiens
  misc_feature: GYAE6OF01BCXYI.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccagttggtgcatcgtgggctgaggtgaagacgccgtggtcctggtgaggtctcctgcaaggcttcgtggacggcctaccttcgagaccgtacttagttacgtttacgaaggtttcggggtagaccgggtaaccgggtccttaccggtagggtaaccgaaacggggttcccgtttagggaacggttaggggtaaggttacgggggtaaacgggtaaccgtttcccgggttaccccttaaggtttaccggttttacgaacccgtaaaccctaaaaccccgtaaaaccgttacccgtaaccgaaaccgtaaacgggttaaacccggtttacccggaacggggaacctaacgggtaaccccttaaccgtaaacccccgtaaaacggtaaacccccgggaaacggtaaaccctaaaaaaccgtttaaaccggaaaaccgttaaaccgtaaacgggtttaaacttacgtaacgggtaaacgtaccgttaacggtaaaacctaccgggtacccgttacggtaacccttacgtaccggtaacggaacggtaaccgttacccgggttacctttaccgttacgtttcccgtaggttaccggtaaccgtaaggttacgttaaacgtttaactaaaccgttaacctaaccgtttaccggttaccctttttaaccccttttaacccgtaccccgttttacccgttaacgttaccggtttcccggtaccgggttacccctaacggttccccgggttaacccccgtaacccg

SEQ ID NO: 104132 - DNA, 825 bp, Homo sapiens
  misc_feature: GYAE6OF01ENJ66.17.34.D01.1.454.CMB.1.raw
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgacaaggtcttcgnggaggctaccttcagcgtactagtagttcgaagttgggngcggacgggcctcgtacggacgaacggtccttaggaggtggtaaggtggggtaaaggtacttccggtaccccttaagttcggttacgaaacctaacctaaaccgaaaacgttaccggacaaacgtaaggtaaacgttaccgagggtactaacggaacctaccgaaccaacgtaaacccgacggtaaaactaaaacgttaaacgaactaacgttaacgttaaactacgtaggaacgtacgtaacgaacgtacgtccgtagtactacgtacgtagaccggtaacggtaccgggtactttaccgttaacgttccgtaggttacggacggttaaacgggtaaacgtttaaacgttaaccgtaaagttaaaccgtaccgttaccggtttacccctttttaacccggtttttaaaccctaaccccgttttcccggtttaacggtaacccccggttttcgggtacccgggggttaaccccttaaaccggggttaacccccgggttaaacccccccggttacgttaaaccccccgggtttccccg

SEQ ID NO: 104133 - DNA, 821 bp, Homo sapiens
  misc_feature: GYAE6OF01AED7N.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcgggtgagggtctcctgcaaggtcttcgtggacggcctaccttcgagcgacttatagtttactaagttgggtcgacggacgggcctcgtaggaaccaacggtccgttaggaggtgggagtaggggaaggtacgttccgtaccctagttcggttacgaaccaccaaccctaaaccgtaccgacgaacgaagtaaacggttacccgaacgggtaccaacgtaccctaccgaaacccgtaaccgtaaaccccgggaaccgggtaaacctaaaaacgttaaacccgaaaccgtaacgttaaacgtttaaacgtccgttaagggaaccgtacgttaacgaaaccgtacggtacccgttacgtaacccaacgttccggtagggaaccggtacccgggtaacgggtttcctttacccgtaacgtttccgtaggttaacggtacgggtaaggtaaacgtttaactttaacgtaagttaaaaccgtcgttaaccgttccttttaccccgttttaacccgaccccgttttccccgttaaggttaccccgtttccgggttaccgggacccttaccgggttaaacccccgggtaacccccgggttaccccg

SEQ ID NO: 104134 - DNA, 630 bp, Homo sapiens
  misc_feature: GYAE6OF01ELWTE.17.34.D01.1.454.CMB.1.raw
  modified_base (336)..(336): a, c, t, g, unknown or other
  misc_feature (336)..(336): n is a, c, g, or t
  modified_base (385)..(385): a, c, t, g, unknown or other
  misc_feature (385)..(385): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctccgtgcaaggcttcgtggaggctaccttcagcgtactatagtttacaagttgggtgcggacggtcctcgtggacaaggccttgacggtggagtaggggaacgtntccgtcctatcgtgacacaccaatcacacagacgtcgaggcacgactanaccacgtaaccgcgaaacaaattaacgaactacaagttaactctaggagtcaagacacgtacctagtacagtctaggacggacgtaccggtcttcgtaacgttcgtagtcgtacggtaagtaacgttaacttactaacttaaccgtactacgttaccttttacccgttttaccctacccttccgttcgtaccgttacggttcgggtacctacggttacccgggaccccgttccgacccgttcccg

SEQ ID NO: 104135 - DNA, 585 bp, Homo sapiens
  misc_feature: GYAE6OF01CD77G.17.34.D01.1.454.CMB.1.raw
  modified_base (247)..(247): a, c, t, g, unknown or other
  misc_feature (247)..(247): n is a, c, g, or t
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctgggtgaggggtctcctgcaaggcttcgnggagcaccttcagcgactatagtttcaagttgggtgcggacgggcctgtggacaaggccttgagtggatggaagatcgtcctatcgttgacacaccaaactacgcaacagaacgtcgagggcaagactcaaccataaaccgnggaacaaaattaacgaacaacaagtaatcngagctagaacagctgtcatctggaagacacgggtaccttctacttcgtgtcgtcggaaggagttaattactaataacacgttcgtcttacccttttaccacccttcccttgtaccttcgtacgggtacctacgtaccggtaaccccggttccgtaacccgttcccg

SEQ ID NO: 104136 - DNA, 788 bp, Homo sapiens
  misc_feature: GYAE6OF01EMPE9.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctccgtgcgaaggtcttcgtgggaggcctaccttcacggccgtaacttaattacggtttacaagtttggggtcgccggtaccggggtccttcggtacgggaaccgtaagggtcctttagggaggttcgggaaggtggggaaacggtacgttccggttacccttagttcggttacgaccaaccaacccaaacgtacgacaacgaagtaacgttccgaagggtacacgtaccctaccgaacccgtaacgtaaacccggacggtaaaacctaaaacttaaacccggaaacctaaaccgttaagtttaaacgtaccggttagggaacgtacgtaacgaaaccgtacgtacccgttagtacctacgtacgtaggaaccggtaccgtacgggtctttaccgttacgttcgtacgtcggtacggtaaggtaacttaagttaacctaataaaccgtacgttacgttaccctttttacccgttttaacctccccgtttacccgtttacgtaccgtttcgggtaccgggtacccttaacgggtccccggtaaccccggttacccg

SEQ ID NO: 104137 - DNA, 740 bp, Homo sapiens
  misc_feature: GYAE6OF01DH44Z.17.34.D01.1.454.CMB.1.raw
tcagcgtagactagcacgaccggtgctcgatttagatcgtctgtgttgggtttggggacaaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtcctctgcaaggcttctggaggcaccttcagcgactatagtttacaagttgggtcgcggacgggtctcgtggacaggtccttggagtggagtaggggaaggacgttccgtcctagttcgttacgacaaccaacctaaacgtaccgaccaacgaaggtaacgttacccgagggtacaacgacctacctaaccgaacgtaaccggaccggtaaactaaaacgtaaacgaacaacgtaacgttaacttacgtaggtaacgacgtaacggtaaacgaacggtccgttaacgtacctaacgttacgtaagggtaaccgggaacggtaacccggggtacctttaccgttaacccgtttcgtacgggtgtaacggtaggtaaacgttaacttacgtaactaaaccgtaacgttccgtacccttttacccgttttaaccacccctttccgttaccttaccggtttcgtacccgggtacctaacggtcccggtaaacccccggttcctacccggttcccc

SEQ ID NO: 104138 - DNA, 880 bp, Homo sapiens
  misc_feature: GYAE6OF01AP1HD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggaccttgaggttcctctttgtggtggcagcagctacaggtgtccagtcccaggtccagttggtgacaatcgtggggctggaggtagaagaccgccgttggggtcctcgggtggtaggttcctccgtgacgtaacggtcgttcgtgggacggcctaccttcgagtcggtaacttagtacgtttacgaaggttgggtgccggtaaccgggtccgtcgtagggaccgtaaagggtcccttagggaggttgggtaacgttagggggaaacggtcgttaccggttacccgtttaagtcggtttcggaaacctaaccgaaccctaaacgtaccgaccgaaacgtacgggtaaacgttcccggaagggactaacgtacctacccgaaccgtaacgtaaacccggaccggtaaacctaaaagttaaaccgaacccgtaaacgtaacggtttaaacgtccgtaagggaacgcgttaaacgtaaacacggtacccgttaggtacctaacgttccgtagggtaaccggtaccgggtacccggggttacctttaaccggtttaccgttacgttaccgggttaggtaacgggtaacggttaacggtttaaaacttacgtaaacctaacccgttaacgttacccggtttcccttttaacccccgtttttaacctaacccccgtttcccgttaccggttaaccccgtttacggggtacccggttaaccccgttaaccggttaccccggggtaaacccccgttttacccccgg

SEQ ID NO: 104139 - DNA, 583 bp, Homo sapiens
  misc_feature: GYAE6OF01BR501.17.34.D01.1.454.CMB.1.raw
  modified_base (321)..(321): a, c, t, g, unknown or other
  misc_feature (321)..(321): n is a, c, g, or t
  modified_base (420)..(420): a, c, t, g, unknown or other
  misc_feature (420)..(420): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtccgtcggtgagggtctcctgcaaggcttcgtggaggcaccttcagcgactatagttcaattgggtgcgacggcctgtgacaaggccttgagtggagtgggaagntcgtcctatcgtgacacgaccaactacgcacagacgtcaggcagactcgaaccataaccgacggaacaaagttaacgaacacgtagttaactcgtagancgtacgaacagcctagtcatcgtgagacgacggtcttacgtactcgtgtcgacggtagacgttaattactaactaacgtacttagtcctttacccgttttaccaccctttacccttacgtaccgttcgtacgggtacctacggtccggtaaccccgttacccg

SEQ ID NO: 104140 - DNA, 779 bp, Homo sapiens
  misc_feature: GYAE6OF01APUBT.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcatcgtgggctgaggtgagacgccgtgggtcctcggtgagggtctccgtgcaggtccttcgtgggacggcctaccttcgagaccggtactagttagtttcctaagtttggggtcgccggaccgggtccctcgtacggaacgaacggtccgttggagtggaagtggggaacggtactccggttacctagtcgttcgaacaccaaccgtaacaccgcacgaagtaccgtccgagggacacgtacctaccaacccgaacgttaacccggaacggtaactaaaacgttaacccgaaacttacgaagtttaacgtaggtacgggtaagtaccgtacgaaaccgtacggaccttcggtaactacttaaccggtacgaaccgggtaacgttaccgggtaccttttaccgttacccgtttagtcggtaccggtaacgggtaacggtaacgttttaaattaccgttaacttaaaccggcccgttacgtttacccttttacccgtttttaaacccctcccgtttcccgtttaaggacccgtttttcccggggtacgggttaccccgttaaccgggttaccccgggtaacccccggttacccg

SEQ ID NO: 104141 - DNA, 872 bp, Homo sapiens
  misc_feature: GYAE6OF01BJXPK.17.34.D01.1.454.CMB.1.raw
tcagcgtagactagcacgaccggtgctcgatttagatcgtctgtgttgggtttggggatcaacaaaacaaccagattcctcctctaaagaacgcccctgggagcacagctcatcaccatggactggacctggaggttcctctttgtggtggcagcagctacgaggtcgtccagtccccaggtccagttggtgcaatcgtggggctggaggtgaagacgccgtgggtccgtcggtggaggtcctccgtgcgaaggtcttcgtgggacggcctaccttcacgacgtacttattagtttacaaggtttcggggtacggccgggaccgggtcccttacgtacggaacgaacgggtcccgtttaggaggtgggaaggtaggggtaacggtaccgttccgttacccttaagtccggtttacgaacctaaaccaaacccgtaaaccgtaccgaccgtaaacggaacgtaaaccggttacccggaagggaccctaacggtaaccctacccgaaacccgtaaaccgtaaacccggacggtaaaccgtaaaaaccgttaaccggaaacctaaacgttaacgtttaacgtacgttacgggaactacgttaacgaaacctacgtacccgtagtacctacgtaccggtaacggacgggaccgtaccggttactttacccgttacgtttcgtaggttacggaacgggttacggtaaacgttaaagtttaccgtaaacttaaacccgtacgtttacccgtttacccttttacccgttttttaaccccgtcccccgtttaccccgtttaggttaccccgttttaacccggggtccgggttaacccccgttacgggttacccccgggtaaccccccgggtttaaccccc

SEQ ID NO: 104142 - DNA, 925 bp, Homo sapiens
  misc_feature: GYAE6OF01EW933.17.34.D01.1.454.CMB.1.raw
tcagcgtagactagcacgaccggtgctcgatttagatcgtctgtgttgggttggggatcacaaaacaaccagattcctcctctaaagaagcccctgggagcacagctcatcaccatggactggacctggaggttcctctttgtggtggcagcagctacgaggtcgtcccacgtcccgaggtccaggttggtgacaagtcggtggggactggaggtaggaacgccgccgtgggtccgtcgggtaggacgggttcctccgtggaccgtaacgggtccttcggtgggacggtcctaaccgttcgacgaccgtaacttaagttacgtttacaaggtttggggtcgaccggtaccgggtccttacggtacgggaaccgtaacgggtccgttagggtaacgggtggggtaacgttacgggggaacggtccgttacccggttaacccgttacgttcggttaaccggaaccctaaacccgtaaacccgtaaaaccgtacccgaacgtaaaccggttaacgggtaaacccgttacccgggaacggggtacctaaaccggtaaccctacccgtaaaaccccggtaaaccggtaaaaccccgggaaaccgggtaaaaaccttaaaaacggtttaaacccggaaaaccttaaccggttaaagtttaaaccgttacgggtaacggtaaaccgaccgttaaggaaaccgtaccgtcgtacgtactacggtacgtacgggaaccggtaccgtaccgggttcttaccgttacggttccgttaggtacggacgtaacggttaacttaaacttacgtaaacctaaccggtacgttaccgtttacccgttttaccccttttacccgtaccctttacccgttagtacccggtttaccgggacgggtaaccctacccgggttaaccccgtacccccgggttaaccc

SEQ ID NO: 104143 - DNA, 796 bp, Homo sapiens
  misc_feature: GYAE6OF01D623A.17.34.D01.1.454.CMB.1.raw
tcagcgtagactagcacgaccggtgctcgatttagatcgtctgtgttgggtttgggatcacaaaacaaccagattcctcctctaaagaagcccctgggagcacagctcatcaccatggactggacctggagttcctctttgtggtggcagcagctacaggtgtccagtcccaggtccagttggtgacaatcgtgggctgaggtgaagacgccgtggtcctggtgaggtctcctgacgaggtcttcgtggacggccaccttcagcgtactagtagtttcaagttggtagcggacgggtcctacgtggacgaaggtccttggaggttggagtaggggaaggtacgtcgtcccgttagttcgttcgaacgaaccgtaacccaaaaccgttaccgacaacgaagtaaacgttccgaagggacaacgacctacccgaaccctaagtaaaccccggacggtaaaaccgaaacgttaaaccgaaacgtaaccttaaggttaaaccgttacgtaggaacgtacgtaacgtaaaccgacgttacccgttagtacctagtttaccgtagggtaaaccgggaccggtaaccgggttccgtttaccgttaaccgtttcgggttacgtcgggtaaccggtaacggtaagtttaaacgtttaacgttaaaccttaaccgttaacgtttaccccgtttaccctttttaacccctttttacccgtacccccgtttaccctttaccggtacccgttttcgggtacccgggtacccgtaaccggttacccgggtacccccgtttaacccccggg

SEQ ID NO: 104144 - DNA, 873 bp, Homo sapiens
  misc_feature: GYAE6OF01AKSDP.17.34.D01.1.454.CMB.1.raw
  modified_base (339)..(339): a, c, t, g, unknown or other
  misc_feature (339)..(339): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtgcagcagctacaggtgtccagtcccaggtccagttggtgcaatcgtgggctgaggtgaagacgccgtggggcctcggtgacgggtcctcctgcaaggtcttcgtggaggccaccttcagcgactattacgtttcaagttgggtgcggacgggtcctcgtggacgaacggtccttgagtggagtgggaacggtntccgttccccgttagtccgttacgaaccaaccgaaccctaaaccgtacgacaaccgtaacgtaacgttcccgagggacctaacggtaccctaacccgaacccgtaaacgtaaacccgggaccggtaaacctaaaaacgttaaacccgaaaccgtaaaccgtaaacgtttaaacgttaccggttaacgggtaacgtaccgttaacggaaaccgtaccggtacccgttacggtaccgtaacgttccgttaacgggaacgggtaacccggtaacccggggttacccgttttacccgtttaacccgttttcgttaccgggttacgggtaaccggtaacgggttaaaccgtttaaaacgttttaccgttaaacgtttaaaccgttaaccgtttacccggtttaccccgtttttaccccttttttaaccccgtacccccgttttaccccgttttaaccgttacccggttttacccgggtacccggggttaaccccgttaccgggtttaaccccgggttaacccccccggtttacccccgg

SEQ ID NO: 104145 - DNA, 899 bp, Homo sapiens
  misc_feature: GYAE6OF01B3YAF.17.34.D01.1.454.CMB.1.raw
tcagcgtagactagcacgaccggtgctcgatttagatcgtctgtgttgggtttggggactcacaaaacaccagattcctcctctaaagaagcccctgggagcacagctcatcaccatggactggacctggaggttcctctttgtggtggcagcagctacaggtcgtccagtcccaggtccagttggtgcagtcgtggggctgaggtgaagcgccgtgggtcctggtgagggtctcctgcgaaggtcttcgtggacgctaccttcgagcgacttagtacgtttcgaagtttgggtgaccggtacgggtccttacgtcggaaccgtaagggtcccgtttaggaacgggttacgggaacggttagggggaaacggttcttacccggggttaccccttaaggttccgggttaccgaaccctaaccgtaaccccgtaaaccgttaaccgacccgtaaaccggtaagttaaacccgggtttcccgaacggggtaccctaacggtaccccttacccgaaaccccgtaaaccggttaaacccccggacggtaaaacctaaaaccgttttaaacccgggaaaccttaaccggttaaacgtttaaacgtcgggttaacgggtaaccgtaccgttaaacggaaaccgtacggtacccgttacggtacctaacgttccgtaacgggtaccgggtaaccggtaccgggttaccctttaccgttaaccgtttcggttaccggtacggtaccgtaagggttaacgttaacttaaccgtaacgttaaaccttaccgttaccggtttacccttttaacccgttttaacccaccccgtttacccgtttacgttacccgtttccgggtaccgggggtaacccctacgggttaaccccgggttaacccccgggttaccc

SEQ ID NO: 104146 - DNA, 812 bp, Homo sapiens
  misc_feature: GYAE6OF01DTJGX.17.34.D01.1.454.CMB.1.raw
tcagcgtagactagcacgaccggtgctcgatttagatcgtctgtgttgggtttggggatcacaaaacaaccagattcctcctctaaagaagccccctgggagcacagctcatcaccatggactggacctggaggttcctcttgtggtggcagcagctacaggtgtccagtcccaggtccagttggtgcaatcgtggggctggaggtgaagacgcctgggtcctcggtggagggtctcctgcaaggtcttcgtggaggcaccttcgagcgactattagtttcaagtttgggtgcggaccgggcctcgtggacgaacggtccgttggaggtgggagtaggggaaggtacgtcccgtaccccgttagtccggttacgaaccaacccaaacctaaaccgtacgaccaacgtaaggtaaccggtttacccgaaggggtaccaacggtaaccctaccgaaacccgtaaacggttaaaacccccgggaaccggaaaaccttaaaaaccgtttaaaaccggaaaaccctaaacgttaacggtttaaaacgttaccggtacgggtaaacgtacgttaacggaaaccgtacgggtacccgttacggtacctaacgttaccgtacggaacgggtaaccgtaaccgggttcctttaccgttaccgtttcgttcggtacggacggtaaggtaacgttaaatttaacctaaacgtaaacctaacgttcgttacccttttacccttttaacctacccctttacccgttacgtacccgtttcggttaccgggacccttaaccggtcccgggtaacccccggttacccg

SEQ ID NO: 104147 - DNA, 604 bp, Homo sapiens
  misc_feature: GYAE6OF01C3A25.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaaggatcgtcctatcgttgacacaccaaactcgacacagaagttccaggcagactcaccataaccgcgaacaaattaacgaacacaagttaatactaggagactagaaacagcctgtacatcagacggacgaccgggtctttactaacctttctggtcgtacgaggtaagttaacttactaacgttaaaccactacgttacctttacccgtttttaccacccttcccgtttacgtacctttcgtacgggtccctaagtaccggtaacccccggtcgtacccgtccccg

SEQ ID NO: 104148 - DNA, 854 bp, Homo sapiens
  misc_feature: GYAE6OF01CQCEI.17.34.D01.1.454.CMB.1.raw
tcagcgtagactagcacgaccggtgctcgatttagatcgtctgtgttgggtttggggatcaacaaaacaaccagattcctcctactaaagaagcccctgggagcacagctcatcaccatggactggacctggacgttcctctttggtggtggcagcagctacgaggtgtccagtcccgaggtccaggttgggtcgactaacgtccggttgggggcttagggaagggtacggaaacggccggtcccggttgggggtccccgttggggtgggtacggggttcccttccgtaggaccgtaagggttcctttccgtggggacggacctacccgttagacgtaccgtacttagttagtttacgtaaggttggggtacgccgggtaccgggtcctccggtaggtaaccgaacggtccgttaggacggttagggaaggttacggggaaacggtccgttaccggttacccgttagttccggttacgaacaacccaaaaccgtaaacgtaccgacaacgtacggtaaaccgttaccggacgggtacaacggtaccttaccgaaacccgtaacggtaaacccggaaaccggtaaactaaaaccgttaacggaaaccttaaacgtaacgttaacgtacgtaacgggtaccgtaacgtaacggtaaccgacgtacccgttagtacgtacgtacgtacggtacggaaccgtcgggtacctttacgttaccgttcgtaggcgaacggttaaggtaacgttaaataacgttacgaacttacgttaccgttcctttacctttacccgtactttcccgttacgttaccgttcgggtaccggtaccgacgttaccccggtacccggttaccc

SEQ ID NO: 104149 - DNA, 632 bp, Homo sapiens
  misc_feature: GYAE6OF01B30U2.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttcgtggaggcaccttcagcgactatagtttcaagttgggtgcggacgggcctctggacaaggccttggagtggagtgggaaggatcgtccctagtcgtgacacaccaaactacgacacagaacgttcagggcagactcaccataacccgacggaacaaacttaacgaaccaacgtaagttaactacgttagagtacgtacgtaacgacgcctcgtacactcgtacggacgacggtaccggtacgtttacttaccgttcgttcggtgtacggaggtacgttaagttaacttaacgtaactaacttcgtccttttacccttttaccttcccttacccttccgttacgttccgttacgggtaccgtcgttaccggaccccggttaccccg

SEQ ID NO: 104150 - DNA, 714 bp, Homo sapiens
  misc_feature: GYAE6OF01EQDZY.17.34.D01.1.454.CMB.1.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (338)..(338): a, c, t, g, unknown or other
  misc_feature (338)..(338): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaggcctgnggaggcaccttnagcgactagttagtttcaagttgggtgcgacgggcctgtggacaggccttgagtggagtgggagatcgtcctagtcgttanacacaaccaactcgacacgagtaacttccgaggccagactaccacctaacgtaacccgacggaacctaaagttaacgaacgtaactaagttaactcgtaaggtacgtacgtaagaacctacgtaccgttacggtactaacgtccggtacgaacgggtaccgtacggggtcctttaccgttaccgttacgttcggtacgtacgggtaacggtaaacggtttaacttaacccgttaagttaaacccgtaagttaccgttaccctttttaccccgttttttaacccgtaaccctttacccccgtttagttaaccccgtttacggttacccgggggtaccttaacccgggttacccgggtaaccccccggttacccccgg

SEQ ID NO: 104151 - DNA, 1200 bp, Homo sapiens
  misc_feature: GYAE6OF01B4G0X.17.34.D01.1.454.CMB.1.raw
tcagcgtagactagcacgaccggtgctcgatttagatcgtctgtgttgggtttggggatcacaaaacaaccagattcctcctctaaagaagcccctggggagcacagctcatcaccatggacgtggaccgtgggacggtttccttcgtttggtgggtggacagcagtctacgagggttcgtccacgtcccgtaggtcctaggttggtgacaagttcggtggggctggaggtagaacgccggtccgttggggtcccttggggtgtacgggttcctccgtggaccgtaacgggttccgtttcggtacggggaccgtcctaaccgtttcgacggtaccgtaaacgtttaacgttaacgttttacgttaagggtttcgggggtaccggccgggtaccggggtccttcgggtagggaaaccgtaaccgggttccgttaggggtacggttagggggtaaggtacgggggtaaacggtaccggttacccggttaccccgtttaggtttaccggtacgaaaccctttaaacccgaaaccccgttaaaaccgtacccggtaccgtaaaaccggtaacgggttaaacccggttaccggaacggggtaacccttaaaccgggaacccgtaaccccggtaaaacccccgtaaaccgggttaaacccccgggtaaccgggtaaaaaaccggtttaaaaaccgtttaaacccggaaaacccgttaaacccggtttaaacggtttttaaaccgtacggggttaaacggggtaaaccgtttaccggttaaaacggaacccgggttaaccggtttacccggtttaacgggtaaaccgtttacggttaacccgggttaaacggggtaaacccgggttaaccccgggggtttaaccggttttaccccgtttttttaaaccggtttacggttttttttaccgggggtacgggttaaccgggtttaaacccggggttaaacggggtttaaaccgtttttaaaaccgtttaaacccgtttaaaacgtttaaaaccccccgtttacggtttaacccccggtttttacccccttttttttaaccccccgtttttaaacccccgtttaaccccccggttttacccccggtttttaaaccgggtttttacccccgtttaacccgggggtttacccggggttaaccccgggtttaaaccccccgggtttttacccccggggggaaaa

SEQ ID NO: 104152 - DNA, 753 bp, Homo sapiens
  misc_feature: GYAE6OF01AM5RP.17.34.D01.1.454.CMB.1.raw
  modified_base (256)..(256): a, c, t, g, unknown or other
  misc_feature (256)..(256): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttctggagcaccttnagcgactatagtttacaagttgggtgccggacgggccttcgtaggacgaacggtcctttggacgtgggaacgtggggaaggtacttccggtcccgttagttcggttacgaacctaccaaccaaacgtaccgacaacgtagaaccgttccgagggaccaaggtacctacaacccgaacgtaacccggacggaaacctaaaacgtttaaacccggaactaaccgtaagtttaaacgtacgtacgggtaacgtacgtacgaaccacggtaccttacgtacctacgtacgtaggaaccgggtaacgtaccgggtactttaccgttacgtttaccgtacggtcgtaacggtaagggttaacgttaaagtttaaccgttaaacgtaaccgtacgtacgttaccctttacccgtttttaacccgtaccctttacccggttacgttaccgttccggtacggttacccgtacggtaacccggtaccccggtccgtaccgttccccg

SEQ ID NO: 104153 - DNA, 793 bp, Homo sapiens
  misc_feature: GYAE6OF01BTRXX.17.34.D01.1.454.CMB.1.raw
  modified_base (191)..(191): a, c, t, g, unknown or other
  misc_feature (191)..(191): n is a, c, g, or t
tcagcgtagactagcacgaccggtgctcgatttagatcgtctgtgttgggtttggggatcaacaaaacaaccagacttcctcctctaaaagaagcccctgggagcacagctcatcaccatggactggactggagttcctcttgtggtgcagcagctacgaggtcgccaacgtcccgaggtcctaggttggngacaatccggtggggctaggaggtagaacgccggtccgttcgggtcccgtagggtgtacgggtcctaccgtggacgaaggtccttggtagggacgtcctacgttacgacgtacgtacgttagttacgttacgtaagggttcgggtacggaccggtaccgggtccgttacgtacgggaaccgtaaccggggttccttagggtacggtagggtaggtaacggggtacgtaccgttcccgtacccgttaagttccggttaacgaacaaccgtaaccaacgttaccgactaaacgaacggttaaccgtcggaacggacgtactaaccgtacaaccgtaacggaaacccggaacgaaaccgttaaacgtaacgaacctaaggtaacgttaacgtacgtaggtaaacgtacgtaaaccgacgaacgtccgtacgtacgtacgtaccgagggaacgtacccgtaacggtcctttaccgttacgtccgtagacggtacgtaagaacttagtaactacgtaccttactcggttaccctttccttaacgtccctttacgtaccgttaccggtacggtcggtaacccgttccggtaccgtaccccggttaccc

SEQ ID NO: 104154 - DNA, 676 bp, Homo sapiens
  misc_feature: GYAE6OF01CI8PP.17.34.D01.1.454.CMB.1.raw
  modified_base (461)..(461): a, c, t, g, unknown or other
  misc_feature (461)..(461): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacaggtgtccagtcccaggtccagttggtgcaatcgtggggctggaggtgaagacgcgtgggtcctcggtgaggtctcctgcaggctcgtggagcacctgagcgactatagtttacgaagttgggtgaccggtacgggtcctcgtacggacgtaacggtccttaggagtggagtagggaagtacgtccgtcccgtagtccgtagactaccaaccaaacgtacgacacgaagtacgtacccgaggtcacgactacaaccgtaacgtaaccgacggaaactaaacgtaacgaaacgtactaagttaancgtaaggacgtacgtaagaacgacgtctacgtcgtaagtcgtacggaacggaccgtaggtacccttcttaaccgtcgtggtagtaccgtaggtaattaactactaagtaacgtcttacgtacctttacccgtttacacccttaccgtttacgacccgttcggttaccgggtacccttacgtaccccgggttaaacccctccggtcccttccccgg

SEQ ID NO: 104155 - DNA, 1037 bp, Homo sapiens
  misc_feature: GYAE6OF01DMUYV.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtgcagcagctacgaggtcgtccacgtcccgaggtcctaggtttgggtgcaacgttcggtgggctggaggtaggaacggacgccgtcgggttccgtgggtggtacgggttctccgtacgcgtaacgggtcttcggtcgggacggtcctacccgttacgacggtaccgtaacttaacgtttacgtttacgtaaggtttggggtacggccgggtaccgggtccgttaccggtacgggaaccgtaaaccggggtttccgttaggggtacgggtaacgggggtaagggttaagggggtaaacgggttaccgttacccggtttacccccgtttaacgtttacccgggttacgaaaacccctaaaccgtaaaacccgtaaaaccggttaacccgaaccgaaaccgttaaacggggtaaaaccggttacccggaaacggggaccgtaacccggtaaaccctaacccgaaaacccggtaaaaccgtaaaaccccggggtaaaccgtaaaaaccgttaaaacgtttaacccggaaaactaaaccgttaacgggttttaaacgtcgggttaaacggtaaccgtaacgtaacggaaacccgtacccgggtaccccgtaacgtttaacgtccgggttaaggtaaacccgggtaaccccgtttaccgggtttaaccctttttcgttaaccggttttcggtacggggtaaacgtacggggttaaacggtttaaactttaaaccgttaaaccgtttaaacgaaccttaacccggtttccttaaccccgttttttaaccccttaacccggttaacccctttcggtaaccggttaccgttaccccgggtacccgggtaaccttaccccggggttaaccccggttaaccccccggttcgttaacccccg

SEQ ID NO: 104156 - DNA, 817 bp, Homo sapiens
  misc_feature: GYAE6OF01E3D9X.17.34.D01.1.454.CMB.1.raw
tcagcgtagactagcacgaccggtgctcgatttagatcgtctgtgttgggtttgggacaaaacaaccagattcctcctctaaagaacgcccctgggagcacagctcatcaccagtggactggacctggtaggttcctctttgtgggtggcagcagctacgaggtcgtccacggtcccaggtcctaggttggtgcaagtcggtgggggctggaggtacgaacggccggtccgttggggtccgtcgggtaggtacgggttcctccgtaggaccgtaagggttccgttacggtacgggaccggtcctacccggttcgaacggtaccgtaacttagttttagttaccgttaaggtttccggggacggaccgggacggtcctggtaaccggacgtaacggttcggttaggaggtaggtaagggtacgggtaaacgtccgtttacccgttaccgtacgtacggtaaccaacctaaacccgaaacgaaccgtaacgaacctaacggtaacggtaccgtaacgggcgaacctacgtaccaacgaaccgaaacgaacggtaacaaacgtaaacgaaacctaagacgttacgtacgacgtagacgtacgtaacgtaacgtccgtacgacgtacacgtacgtaacggaaccggtccgtacggttactttacgttacgtggtacgtacgggtaacgtaaagtaacttaacctaacgtaacttacgttcccttacttaccccgttttacctacccgttaccttacccgtcgttccgtaacgggtccgtaaccggtacccgtaacccgtaccccgttacgcccgttacccg

SEQ ID NO: 104157 - DNA, 820 bp, Homo sapiens
  misc_feature: GYAE6OF01DZUNQ.17.34.D01.1.454.CMB.1.raw
tcagcgtagactagcacgaccggtgctcgatttagatcgtctgtgttgggtttggggatcacaaaacaaccagattccctcctctaaaagaagcccctgggagcacagctcatcaccatggactggacctggagttcctctttgtggtggcagcagctacaggtgtccagtcccaggtccagttggtgacaatcgtggggctggaggtgaacgcgccgtgggtcctgggtgacgggtctccgtgacgaaggtcttcgtgggacgtcctaccgttcgacgcggtaacttagttacgtttacgaagtttggggtacggacggtaccggggtcctacggtacgggaaccgtaagggttccgttaggtacggtgggaagtacggggaaggtcgtccgttacccttagttccggttagaaccaccaaccgtaaaccgtacgaacaacgtaacggtaaccgtttaccggaagggacctaacggtacctaccgaacccgtaaacgttaacccgggaacggtaaaactaaaacgttaaacccgaaaccgtaaacgttaaacgtttaacgtacggtaagggtaacgtaaccgtaagaaccgtacggttaccctacgtacgtacgtaccgttaacggaacggtaaccggtacgggttacctttacgttaccgtttccggttaggtaccggtacggtaagggttaacgttaaacgttaacttaacgtaaactaccgttacggttaccctttacccgttttacctaccctttcccgttaacgttcccgttacggtacggtacctaccggtccccggtaacccgttaccccgg

SEQ ID NO: 104158 - DNA, 600 bp, Homo sapiens
  misc_feature: GYAE6OF01B10QN.17.34.D01.1.454.CMB.1.raw
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (539)..(539): a, c, t, g, unknown or other
  misc_feature (539)..(539): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccagttggtgcaatcgtggggctgaggtgaagacgccgtgggtcctggtgagggtctcctgcaaggtcttcgtgggaggccaccttcagcgacttatagtttcaagttgggtgccgacggcctgtggacaaggtccttagaggtggagtgggaagtacgtccgtaccctagtcgtgaaccacaccaactacacacgagtacgtcgaggcacacncaccagaccgngaacaatacgaanacgtatactntaganctagacngtactgactatcgagacgaccgcggtcttcgtacttgtcgtacgacgtaaggtacttaagttacctaagtaccacgttacgtaccttttacccttttaccnccctttaccttcgttaaccgttccggacgggttcccacgtacccggtaccccggtaccccg

SEQ ID NO: 104159 - DNA, 942 bp, Homo sapiens
  misc_feature: GYAE6OF01DNYFX.17.34.D01.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
tcagcgtagactagcacgaccggtgctcgatttagatcgtctgtgttgggtttgggatcacaaaacaaccagattccctcctactaaagaacgcccctgggagcacagctcatcaccatggactggacctggacggttccttctttggtggtggcagcagctacgaggtcgtccacgtcccgaggtcctagttggtncaagtcgtggggctggaggtgaagcgccgtgggttcctgggtgaggtcctccgtgacgaaggtccttggngggacgcctaccgttcgagcgtaacttagttacgtttcgaaggtttgggtacgcggtaaccggggtcctacgtacgggtaacgaacggtcccgttagggaggttcggggaaggttacggggtaaaggtaccgttaccgtttacccgttaagttaccgggttaacggaaacccctaaccgtaaaaccccgtaaacgttacccgaccgtaaacggtaaaacggtaaccggttacccggaaacgggttaccgaaacggtaccccttaacccgaaaccccgtaaacgggtaaaaaccccggtaccgggtaaaaaaccgttaaaaccgttaaacccgaaaaccgtaacggttaaaaccgtttaacggttaccgtacgggaacgtaaaaccgttacggaaaccgacggttacccttacggtaacctagtttacccggtacggaaacgggtccgtaacccgggttccttttaaccgttaccggttttactcgggtaaccggtacggtaaaggttaccgtttaaaattaacccgtaaacttaaccgttaccgttaccgttttaacccgttttacccgttttaacccgttaaccccccgtttacgttaccggttaacccgttttaccgggacggggtttaacccctaaccgggttaaccccgggtaccccccggtttaaccccg

SEQ ID NO: 104160 - DNA, 878 bp, Homo sapiens
  misc_feature: GYAE6OF01D98AB.17.34.D01.1.454.CMB.1.raw
  modified_base (264)..(264): a, c, t, g, unknown or other
  misc_feature (264)..(264): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggaggtttccttcgtttggtggtggcagcagctacgaggtcgtccagtcccaggtcctagttggtgcaattcgtggggctgaggtagaacgccgccgtgggtcctcgggtgacgggtctccgtgcaaggcttcgngggacgcctaccttcgagcgtaacttagttacgttttacctaaggtttcggggtcgaccgggtaccggggcccttcgggtacggaaccggtaaacggggtcccgttttagggacggggttacgggtaagggttacgggggtaaacggtccgtttacccgggttacccgtttaacggtttcccggttttaacggaaaaccccgtaacccgtaaaaccccgttaaaaacccgttacccggaaccctaaaccggtaaacgggttaaacccggttacccgggaacggggtacccgaacggttaaccctacccgaaacccgtaaacggtaaaaccccggaccgggaaactaaaaacgttaaacccggaaacctaaaccgtaagttaacttacgtacgggaacgtacctaaggaaaccacggtcctacgtacgtattaccgaggtaaccggaccgtaacgggtcctttaccgtaccgttcgtaggtacgcggttaaacgtactttaacgttaacttaacgtaactacgttcgttaccttttaccctttaaccctccctttacccgtttacgtacctttcccggacgggtactaccgggttccccggaaccccgttacccg

SEQ ID NO: 104161 - DNA, 636 bp, Homo sapiens
  misc_feature: GYAE6OF01B3DMO.17.34.D01.1.454.CMB.1.raw
  modified_base (333)..(333): a, c, t, g, unknown or other
  misc_feature (333)..(333): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggcttcgtggacggctaccttcagcgactatagtttcaagttgggtgcggacgggcctcgtggacaaggccttgaggtggagtgggaagntcgtccctatcgtagacacaacaaactcgacacagaacgttccgaggcaagactaccaccacgtaaccgacgaactaaactaaccgaacactaagttaactacgtaggacgtctaacgaacgcgtacctcgtacgtagtacgtaggaacggaccgtacgggtctttacctactttcgtagtacggacggtaaggtacttaattaactaactaactaccttcgttacctttaccctttaccctccccttaccttcgtacgttccggtcgggaccctacgttcccgggtaacccccgttacccgg

SEQ ID NO: 104162 - DNA, 788 bp, Homo sapiens
  misc_feature: GYAE6OF01BEXYU.17.34.D01.1.454.CMB.1.raw
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccaggttggtgctaatcgtggggactggaggtgaagacggccgttgggtcctgggtggacgggtctcctggcaaggtcttgtgggacggcctaccttcgagtaccgtaacttagttagtttactaaggtttcggggtagccggacgggtacccttcggtacgggaacctaacggtccgtttaggaggtagggaagtggggaacggtcttaccgtcccttagttcggtacgaacctaacaaccgtaaacgacgactaacaacggtaacgttccggaaggaccaacgaccctaccgaaacccgtaacgtaacccggacgtaaacgttaaacttaaaccgaaacctaacgttaagttaactacggttaaggaacgtacgtaacgaacgtaccgtaccgttagtaccctaagtcgtaacggtacggtaccggtaacggttcctttacgtacgttcgtcggtacggtacgtaagggtacttaaacgtaccttaaagttaccgtaaccgtttccgttacccgtttttaccccttttaaccgtaccccgtttccgtttactacccggtttccggtacgggacccctttacgggttaaccccggtacccccggttacccg

SEQ ID NO: 104163 - DNA, 702 bp, Homo sapiens
  misc_feature: GYAE6OF01BVLY6.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggtcttcgtggaggcaccttcagcgactatagtttcaagttgggtgcggacggcctcgtggacaaggtccttggagtggagtaggggaaggactcgtcccctagtcggttcgaactaccgaaccaaaactaccgacaacaacgtaagttaccgagggcagacctccaaccaacgtaacccggacggaacctaaaacttaaccgaaactaaccgtaagtttaacgtacgtagggaacgacgtagaaaccgtaacgtacccgttagtaccacttaccgagaacggaccgaccgggttccgtttaccttacgtttcgtacgttacggacggtaaggtaacgttaaacttactaaacttaaacctacttcggtaccctttccctttttaaccctaccccgtttcccttacgtacctttccggtacggggtaccctacgttacccgggtaacccccggttacccg

SEQ ID NO: 104164 - DNA, 751 bp, Homo sapiens
  misc_feature: GYAE6OF01DEYYX.17.34.D01.1.454.CMB.1.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacccgacttaaaccgggacaaccgtcgcccgccaacatacgccttcctcccgtcccccctcgcacgtaacacaagtacagaatacttaacctgttccatcactacgccttcgcctcgccgttagggtcactcacctcgccccgtattaacgtcggacacggtaacccgttcggtccgttccgggcgacggtccgggttaccttttccgaccccgtacttttactaccgtttactttagtcgtacgacgtctactttccgactacctttctacgtaacctacccgttccagtacctaacgtcgtaccctccaaaccgtacgaccctaacccgtaaccctttaccaaacgaccggttacctttaaccgaaccgtaaacccgtcccctaacccccgtaaccccaaaccgtaaccgactaaacgtaacggcccgtaccgtaccgtccgacccgcgtaccggtcgtttacggcgtaccgttagttaccgggtttaacccgttcccccgtttactacccgttacccgttccccgaccttacgttccgtacgtaaccgtcgtcccgtaccgg

SEQ ID NO: 104165 - DNA, 894 bp, Homo sapiens
  misc_feature: GYAE6OF01DA4WL.17.34.D01.1.454.CMB.1.raw
  modified_base (288)..(288): a, c, t, g, unknown or other
  misc_feature (288)..(288): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccagttggtgcaatcgtggggctgaggtgaagacgcctgggtcctcggtgagggttctcctgcaaggcttcgtggacggcaccttcacgcgacttatagtttcaagttgggngcgacggcctcgtggacaggtccttggagtgggagtagggaaggtactccgttccctagtcggttacgaacctaaccgaaaccaaaaccgttaccgaccaaacgtaaacggtaaaccgttaccggaacgggaccaacggaacttaccccgaaaccgtaaacgtaaaccccggaccggtaaaaccgtaaaacgttaaaacccggaaaacctaacccgttaaacgtttaaacgttaacggtacgggtaaacggtaccgtaaacggtaaacccgaacgtacccgttacggtactaacgttaccggttaaggtaaccggggtaaccgtaaccggggttaccttttacccgtttaaccgttttccggttcgggttacggtaaccggggttaaacgggttaacggtttaaaaccgtttaaaccgttaaaaccgttaaaaccgttaccgtttaccgtttaacccgtttttaccccctttttttaaaccccggtaccccccgtttttaccccccgttttaaccgggttaccccggttttacccgggttaccgggggttaaccccgttaaccgggtttaacccccggggtaaaccccccgggtttaaccccccgg

SEQ ID NO: 104166 - DNA, 703 bp, Homo sapiens
  misc_feature: GYAE6OF01BEW4B.17.34.D01.1.454.CMB.1.raw
  modified_base (267)..(267): a, c, t, g, unknown or other
  misc_feature (267)..(267): n is a, c, g, or t
tcagcgtagactagcacgaccggtgctcgatttagatcgtctgtgttgggtttggggatcacaaaacaaccagacttcctcctctaaagaagcccctgggagcacagctcatcaccatggactggacctggaggttcctctttgtggtggcagcagctacgaggtggtccagtcccaggtccagttggtgcaatcgtggggctggaggtgaagacgcctgggtcctcggtgagggtctcctgcaagggcttctgggacggcaccttnagcgactaattagtttcaagttggggtgccggacgggcctcgtaggactaaggccgtttggaggtgggagtaggggaagggtatccggttccctagttcgttagaacctacaaccgtaaactaccgctaacaaggtaacgttccgagggcagacctacaccgaataacccggcggaaactaaaagttaaaccgaaactaactaagttaatacgaggagtacgtagaacacgtaccttacgtactatcgtaggacggtaacgtacgggtctttcgttaaccgttcgttggtacggtacgaagggtaacgttaagttaactaacgttaacctaacttcggttacccttttacccgtttttaaccctaccccttacccgtttacgtaccgtttccggtcgggtaccgtaaccgtcccggggtaacccccggttacccgg

SEQ ID NO: 104167 - DNA, 644 bp, Homo sapiens
  misc_feature: GYAE6OF01B9G0B.17.34.D01.1.454.CMB.1.raw
  modified_base (339)..(339): a, c, t, g, unknown or other
  misc_feature (339)..(339): n is a, c, g, or t
tcagcgtagactagcacgaccggtgctcgatttagatcgtctgtgttgggtttggggatcaacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgacggtctcctgcaaggcttcgtggacggcaccttcagcgaactattacgttctaagttgggtcgcggtacgggcctcgtaggacaaggtccttggagtggagtgggaagtntcgtcctagtcgtgacacaaccaactcgacacagaacgttcgagggcagctaccacacgtaaccggcgaaactaaactaaacgaacaacgtaacgttaacgtacgtaggagtcgtaagaaaccgagtcccttagtactacgttacgacggtaacggaccggacgggtctttaccgttacgttcgtgtacggtacgtaaggtactaattactaataaccacgttcgtcctttaccttttacctaccctttacccgttcgttacttccggtacggtaccctacggttacccggtaaccccggtcccg

SEQ ID NO: 104168 - DNA, 629 bp, Homo sapiens
  misc_feature: GYAE6OF01AXMLP.17.34.D01.1.454.CMB.1.raw
  modified_base (317)..(317): a, c, t, g, unknown or other
  misc_feature (317)..(317): n is a, c, g, or t
  modified_base (491)..(491): a, c, t, g, unknown or other
  misc_feature (491)..(491): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgcaatcgtggggctgaggtgaagcgcctggggtcctcgggtgagggtctcctgcaagggcttcgtggaggccaccttcagcgactatagttcaagttgggtgcgacgggtcctcgtggacaaggccttgnggtggagtgggaaggtctcgtccctatcgtgaccacaacctaactacgcaacagtaacgtccgagggtcacgtactcaccagtaacccgagaactaaacttaacgaactactaacgttaactcgtaggacgacgtacgaacagccttaggcctatcgtaggacgacgaccggtntttaccgtcgttctggtcgtaggtagtagtaacttacgtaactaaccgtcttacgccttttaccctttaccgtccccttacccgttacgtccgtttaccggtcgggtaccctacggttcccggaacccccggttaccg

SEQ ID NO: 104169 - DNA, 555 bp, Homo sapiens
  misc_feature: GYAE6OF01B5P9X.17.34.D01.1.454.CMB.1.raw
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
  modified_base (410)..(410): a, c, t, g, unknown or other
  misc_feature (410)..(410): n is a, c, g, or t
  modified_base (462)..(462): a, c, t, g, unknown or other
  misc_feature (462)..(462): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggagcaccttcagcgactatagtttcaagttgggtgcgacgggcctcgtggacaaggccttgaggtggatgggaaggntccgtccctatcgtgacacaccaaacncgcaacgagtagtccaggcagactcacataccgacgacaaataacgaacacagttantggagctagacagcctagtcatctgaggtaccacgggtcttacttaccgttntgtcgcgaggtataagttactatacactcgtccttccttttactcccttcctttacctcgtcgggtacctagtaccggaccccgttctacccg

SEQ ID NO: 104170 - DNA, 689 bp, Homo sapiens
  misc_feature: GYAE6OF01CZN11.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaaggacgccgtgggtcctcggtgacgggtctccgtgcgaaggtcttgtggagccaccgttcagcgtaactattagtttcgaagttgggtacgcggaccggctcgtacggacgaggtcttaggagtggagtagggaagacgtcgtctagtcgtagacgtacaaccgaaacgtcgacaacaagtaacgtacagggactaagacctacaaccgtaagaaccccgagtaaacaaaattaaccgaacgtactaagttaacgtcgtaggacgactacgaacgacgtactacgtatacgtcgtagaccggaacgtacggtctttactacgttaccttaggtacgtaacggtaggtaagttaaacttacgtaaattaaccgtcgttacgttacccgtttacctttaacccgacccctttaccgttcggtaacccgtttcgggtaccggtacccgttacggtaccccggtaacccccggttctaaccccggttccc

SEQ ID NO: 104171 - DNA, 949 bp, Homo sapiens
  misc_feature: GYAE6OF01D9NKF.17.34.D01.1.454.CMB.1.raw
  modified_base (99)..(99): a, c, t, g, unknown or other
  misc_feature (99)..(99): n is a, c, g, or t
  modified_base (192)..(192): a, c, t, g, unknown or other
  misc_feature (192)..(192): n is a, c, g, or t
tcagcgtagactagcacgaccggtgctcgatttagatcgtctgtgttgggtttggggacaaaacaaccagattcctcctctaaagaacgcccctgggancacagctcatcaccatggactggacctggtacgttcctctttggtggtggcagcacgctacgaggtcgtccagtcccacggtcctaggttggnactaagtcggtggggactggaggtagaacggacgtccggttcgggtcccgtgggtggtacgggttcctccgtggacgtaggtccttcgtacgggacgtcctaccgttacgacgtaccgtattacgttaggttacgtaaggttcgggtcgaccggtacgggtcctggtacggacgtacggtccgtttagggacggtaggtacggagggtaacggtccttccggttaacccgtggttccgtacgaaacccgtaacccgtaaaccgtaacgtccgactaaacggtacggttaaaccggtccggaacggtaccaaccggttaacccgtaccgaaaccgtaacggtaaaccccggaaggttaaaaaccctaaaacgtttaaaccgaaccgtaacgttaacggtttaaacgaccgggttaacgggtaactaaccggtaacggaaaccgtaccgttaccgtaacgttaaccgtagggtaaccgtaacgggtacccggtaacggttaaccccggttctttaacccgtttcggttaacggtcggtaacggggttaaaccggttaagggttaaccctttaaacggtaaccgtttaacccgtaacgttaaccccgggttttaacttttaacccccgtttttaaccccgtttacccgttaacccgtttaccccgtttaacggttccccgggttacccggttaaaccggggtacccccttacgggttaaacccccgggttacccccttaacggtttccccgtaacccccg

SEQ ID NO: 104172 - DNA, 640 bp, Homo sapiens
  misc_feature: GYAE6OF01D0UBV.17.34.D01.1.454.CMB.1.raw
  modified_base (377)..(377): a, c, t, g, unknown or other
  misc_feature (377)..(377): n is a, c, g, or t
  modified_base (441)..(441): a, c, t, g, unknown or other
  misc_feature (441)..(441): n is a, c, g, or t
  modified_base (469)..(469): a, c, t, g, unknown or other
  misc_feature (469)..(469): n is a, c, g, or t
tcagcgtagactagcacgaccggtgctcgatttagatcgtctgtgttgggttgggatcacaaaacaaccagattcctcctctaaagaagcccctgggagcacagctcatcaccatggactggacctggaggttcctctttgtggtgcagcagctacaggtgtccagtcccaggtccagttggtgcaatcgtggggctgaggtgaagacgccgtggtcctcggtgaggtctcctgacaggtccttcgtggacggcaccttcagcgtacttattagtttcaagtttgggtcgacggaccggtctcggtaggactaacggccttggaggtggagtaggggaagactcgttcctagtcgtgaccacaaccaactacgacanaacgagtccgaggcacgactcaaccagaaccgacggaaacaacttaacgaacaacctaagttanacgtaggaacgtactagaactcgacgtnactagtcgagtacgaccgtacggtccttacgtacgttcgtcggtagtaccgggtaaggtactttaaagtctaaatacctacgttacgttccctttaccttttacccacccgttcccgtttcgtaccgtttccgggtacggtaccctacggtccccggtaacccggtacccg

SEQ ID NO: 104173 - DNA, 746 bp, Homo sapiens
  misc_feature: GYAE6OF01CTE5E.17.34.D01.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagcgtagactagcacgaccggtgctcgatttagatcgtctgtgttgggtttggggacaaaaacaaccagattcctcctctaaagaacgcccctgggagcacagctcatcaccatggactggacctggaggttcctctttgtggtggcagcagctacaggtgtccacgtcccgaggtcctaggttggtgacaagtcgtcggggactggaggtagaacggcgccgtgggtccgtgggtggacgggtctccgtgacaaggtcttcgnggacggctacctnagcgtaacttagttagttcaagttgggtacggcgaccgggtcctcgtggacgtaacggtcttaggacggtggaagtagggtacgtagtccgtcctagttcgtagacctaaccgtaaccaaacgtcgaacgacaaggaacgtccgaaggaccaagaccgtaacgaaccaggtaaacccggacggaaactaaacgttaacgaactaaccggtaataagtacggtaggaactacgaacgtaacgacgtaccgtgtaacacgttaacgtgaacggacccggaggttaccctactttacgtcgacgtagggtaaccggtaaggttaacttaacgttacttaacgtaacgttccgttacgttaccctttaaccctttacccgtaacccgttccctttacttaccggttccgggttaacccgggtaccctaacggttaccccggggtaccccctacggttaccccgttacccgg

SEQ ID NO: 104174 - DNA, 762 bp, Homo sapiens
  misc_feature: GYAE6OF01B04PL.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgcaatcgtggggctgaggtgaagacgccgtggtcctcggtgacgggtctctgcgaggtcttcgtggacggcaccttcagcgacttatagtttcaagttgggtgcggacgggtcctacgtggacaacgggtcctttagtaggtgggaaggtaggggtaaaggcttaccggtcccgttaacgttccggttacgaaccgaaccaacccgaaaccttaccgccaacgaacggtaacgttacccgacgggacaacgaccgtaccaaccgtaacgtaaacccggacgggtaaactaaacgttaaccgaacgtaaccgtaagtttaactcggtaaggacgtaacgtcgaaaccacggtaccttaggtaccacgttacgtacggaacgtacccggtacgggtcctttacgtactttccgttagtacggacggtaggtaacgtttaacgttaagttaactaaacgtacccgttacgttcccttttacccctttttacccgtccccgtttacccgttaccggttacccgtttcggtaccgggggtacccttaccggttaaccccgggacccccggtttaaccccg

SEQ ID NO: 104175 - DNA, 788 bp, Homo sapiens
  misc_feature: GYAE6OF01EQ9HB.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctccgtgcaaggcttcgtggaggcaccttcagcgactatagtttcaagttgggtgcggacggtctcgtggacaaggtccttggaggtggagtaggggaacggtactccggttacccctagttccggttcgaaccaaccaaccctaaacgtaccgacaacgaagtaacgttccgaagggaccacgacctaccaaccgtaacgtaaaccccggacggtaaacctaaacgttaacccgaaactaaaccgtaacggttaaattccggtaagggtaacgaccgttaacggaaaacctaccggtaacccgttacggtaacctagttaccgttacggaacgggtaaccggtaaccgggttcctttaaccggttccgttttaccggttaggttcgggtaaccggaagggtttaaactttaaacgtttaaacccttaaagtttaaacccgaacctttacggttaccctttttaccccttttaacctaccccttttaccccgttaggtaccccgtttacggtaccgggtaccccttaacggttaccccgggtaacccccgttaccccg

SEQ ID NO: 104176 - DNA, 641 bp, Homo sapiens
  misc_feature: GYAE6OF01BDBSY.17.34.D01.1.454.CMB.1.raw
tcagcgtagactagcacgaccggtgctcgatttagatcgtctgtgttggggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgccgtgggtcctcggtgagggtctcctgcaaggtcttcgtggagcaccttcgagcgacttatagtttacaagttggtagcggtacgggccgtctggacgaaggtcctggacgtggtaggtggggaagtacgtccgtcctagtcgttagaccacaaccaaacgtcacgaacaagtacgttaccgaggacacgactacaacctaacgtaacccggacgaactaaaactaacgaacaatacgttaactacgtaggactcgtaacgaactacgtccgtagtacacgtcgtacgacgtaaccgtacgtcgttactccgttcgtagtacgtggtaaggtacttaattaactaactaacacttatccctttaacctttcctaccttccttacgtacgtcgtccggtacacgtacccggtaccccgttccgcccgttcccg

SEQ ID NO: 104177 - DNA, 957 bp, Homo sapiens
  misc_feature: GYAE6OF01AMLKK.17.34.D01.1.454.CMB.1.raw
  modified_base (783)..(783): a, c, t, g, unknown or other
  misc_feature (783)..(783): n is a, c, g, or t
tcagcgtagactagcacgaccggtgctcgatttagatcgtctgtgttgggtttggggatcaacaaaacaaccagattcctcctctaaagaacgcccctgggagcacagctcatcaccatggactggacctggacggttcctctttggtggtggcagcagctacgaggtcgtccagtcccaggtcctaggttggtgacaagtcgtgggcgtggaggtagaacgccgccgttgggtccgtcggtggtacgggttctccgtacggacgtaacgggtccgtttcgtagggacgggtacccctaccgtttaccgacggtaccgtaacgtttacgtttaacggttttacgtaaggtttcggggtcggacccgggtaccgggtcccgttcggtacgggtaaccgtacgggttccgtttagggacgggttacggaacgggttacggggtaacggtacgttccccggtttaccccggttaagttaccgggttaccgaaacctaacccggaaaaccctaaaccggtcccgaacgtaacggtaacggtaacggttacccgggaacgggtaccctacgtaacccgttaacccgaaacccgtaaaccggtaacccgggtaaacgtaaaaccgtaacttaaacccggaactaaccgtaacgtttaacgtacgtaacggtacgtaacggtaacgtaaaccgcgttaccgtacgtaaccgtacgtttacggaacgggtaaccggtacccggtaacgggtttacctttaccgttaacgtttaccggttccggttaacggnggtaaacggttaaccttaaaccgtttaactaaaccggtaacttacccggttacctttaccccggttttaaccccttttacccgttaccccgttaccgggttttaaccgtccgggtttacgggtaccccggggttaactaccccggggtaccccgggtttaccccgttaccccgg

SEQ ID NO: 104178 - DNA, 670 bp, Homo sapiens
  misc_feature: GYAE6OF01E09X5.17.34.D01.1.454.CMB.1.raw
  modified_base (284)..(284): a, c, t, g, unknown or other
  misc_feature (284)..(284): n is a, c, g, or t
  modified_base (327)..(327): a, c, t, g, unknown or other
  misc_feature (327)..(327): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggctaccttcagcgactatgtttacagttgggngcgtacggcctcgtggacgaggtccttgaggtggatgggaagntcgtacctgtcgttagaccacaaccaacgtacgctaacagtaacgttccgagggtcaagacctaccgaaccctaactaacccggaccggtaactaaaaccgttaaccgaaacgtaacgtaacgtttaactcgtaggaacgtacctacgaaaccgagtacctacgtctacgtcgtacggaacgtaccgtacgggtcctttacctacgtttcgttggtacgtaggtacggtaagttaacgttactaagttaaccagttaccgtacgtttacccttttaacctccctttcccgttacgtacgtttccggtacgggtaccctacgttcccggtaacccccgttcccg

SEQ ID NO: 104179 - DNA, 794 bp, Homo sapiens
  misc_feature: GYAE6OF01AM2HB.17.34.D01.1.454.CMB.1.raw
  modified_base (701)..(701): a, c, t, g, unknown or other
  misc_feature (701)..(701): n is a, c, g, or t
tcagcgtagactagcacgaccggtgctcgatttagatcgtctgtgttgggtttggggacaaaacaaccagattccctcctctaaagaagccccctgggagcacagctcatcaccatggactggacctggaggttcctctttgtggtggcagcagctacaggtgtccagtcccaggtccagttggtgcaatcgtgggctggaggtgaacgacgccgtgggtcctcgggtgacgggtctccgtgacgaaggtcttcgtggacgtctaccttacagcgacttagtacgtttacgaagttggggtacgaccggtaccgggcctacgtcggaaccgaacggtcccgttaggtaggtaggtaagtacggggaaaggtacgtacccggttacccctaggtaccgttacgaaacccaccgaaaccctaaccgtaccgacctaaccgagtaccgttacccgagggaccaacgacctaccgaacccgtaacgaacccggacgtaaacctaaacgtaaccgaacgtaacgtaaggttaactcgtaggaagtccgtaacggaaaccgtccgaccgttacgtactacgtaccgtaggaccggtaacgtaccgggtctttaaccgtcgtttacgtacggtcggtaacggaaggttaacttaacgttacctaaacgtacctacgttaccgttacccgtttaacccgttttaacccnccctttacccggttcgttaccccggtttccggtacccgggtacccttacccgggttaacccgggttaccccccgttcccgtcccgttaccccg

SEQ ID NO: 104180 - DNA, 612 bp, Homo sapiens
  misc_feature: GYAE6OF01BP5TV.17.34.D01.1.454.CMB.1.raw
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
  modified_base (571)..(571): a, c, t, g, unknown or other
  misc_feature (571)..(571): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttggtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctcgtaggacaaggccttgagtggagtgggaagtntccggtccctagtcgttagacacgaccaaactacgcanagaacgttccaggcagactacaccagtaaccgcggaacaaacgtaaccgaacacgtaagttaaatcgtaggacgctagaacacgacccttgtccatcgttagacggaaccgtcggtctttaccgtacgttccgtacgtagcggtaaggtagttaacttaaccgtaataacctacgtcgtccttaccttttaccctacccttcccgttntaccttcggtcgggtaccacgttaccgggacccccgtaccg

SEQ ID NO: 104181 - DNA, 1039 bp, Homo sapiens
  misc_feature: GYAE6OF01ENJFZ.17.34.D01.1.454.CMB.1.raw
tcagcgtagactagcacgaccggtgctcgatttagatcgtctgtgttgggtttggggatcacaaaacaaccagattcctcctctaaagaagcccctgggaacacagctcatcaccatggactggacctggacggttccttctttgtggtggcagcagctacgaggtgtccacgtcccgaggtcctaggtttgggtgactaagtcggtggggctaggaggtagaacggaccggtccgttcggggtccttcggggtaggacggggttccctccgtggaccgtaaacgggttcctttacggtcggggaacggtccgtaccccgtttacgaacggtccgtaacttaagtttacggtttttaaccgtaaagggttttcgggggtcgtacccggggtaaccgggtcccgtttacggttaccgggaaaaccggtaacggggttccccgtttagggtaacggggttacggggtaaacgggtttagggggaaaaccgggttacgtttccccggtttaacccgtttaacggtttcccgggtttaacggaaaacccctaaacccgttaaaaaccccggtaaaaccgttaacccggggaacctaaaaccggtaaacggtttaaacccgggttacccgggaaacgggtaaccgtaacgggttaaccctacccgtaaacccgtaaaacccggttaaaccccggaaaccggttaaaaaccgttaaaaacccggttaaaacccgtaaacgtaaaaccggttaaacgtttaaaccgttcgggttaaacgaacgtaaccgttaacggaaaccgttacggtacgttaccgttaactacgttacgtacgggtaacggtaaccgtaccgggttcctttaacgtttaaccggttcgttagggttaacgaccgggttaaagttaacgtttaaacttaccgttaaacttaaaccgttccgtttaacggttacccttttacccttttaacccgttacctttcccgttagttacccgttaccgtacgggtaccctacggttacccccggtaccgtcccgttaccg

SEQ ID NO: 104182 - DNA, 1200 bp, Homo sapiens
  misc_feature: GYAE6OF01DV3A3.17.34.D01.1.454.CMB.1.raw
  modified_base (164)..(164): a, c, t, g, unknown or other
  misc_feature (164)..(164): n is a, c, g, or t
tcagcgtagactagcacgaccggtgctcgatttagatcgtctgtgttgggtttgggatcacaaaacaaccagattcctcctctaaagaacgcccctgggagcacagctcatcaccatggactggacctggagttcctctttgtggtgcagcagcctacaggtcncccactccagttgcagcgtggtgcagtcgtgggctggaggtagaagacgccgtcgggggtcctacgaggtagtaacggttcctccgtagtacgaaggttccttcgtagggtattttacccgaaccggtttttacccttaccttaagttaacgtttacgttaacccgtaacggtttgggggtacccgaccgggtaccccggtaacggggtcccccggtaacggttccggggaaaacccctaaaccgggtacccggtttaggggtaaccgggttaggggtaacggggtacggggtaaccgggttaccggggtaaaaccccccggtaaaccccgttaaaccggacccggttttacggggttacccggtttaaccctaaccgggttacgtttccccgggtttaaccgttaaccccccgtaacccccgttaaccggtttccccccggttaaacccccggggaaattaccccgttaaaaccggtttaccccaaacgggttccccgtaaaaccccggtacccggtttaaaaccccctcccccgtttaaaccccgtaaaaccccgttaaaaaccaaccccccgtaaacccgggtttaaacccttaaacggtaaaccggggtttttaggggtaaaccgggtttaaaggggtaaaccgggtaccccgggtttaaccctaacggggtaaaccccttaaccgggtttttaccggaaacccccggggttaaacccggggtaaccccggtaaaacccccgggggttttttaccccggtttaacgttttttaaaacccccggttaacgggggtttcccggtaaacggggggttaaccccccgtaaacggttacccccccgggggtaaaccccttaaacccgggggttttaccccgggttaaacccccgggggggaggtttacccccgggttaaacccccccggtttaacgggggtacccggttaaaaccccccgggttttccgggttttaacccccggttttttaaccgggggtccccggttttcccggggggtaaaaaccccccgggggg

SEQ ID NO: 104183 - DNA, 858 bp, Homo sapiens
  misc_feature: GYAE6OF01CPCUW.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacaggtgtccagtcccaggtccagttggtgcaatcgtgggctgaggtgaagacgccgtgggtcctggtgaggtctccgtgacgaaggtcttcgtggacgcctaccgttcgagaccggtacttagttacgtttcaaggtttggggtacgccggtaccgggtccttcggtacggaacgtaacgggtccctttaggacggttagggaagtacgggggaaacggttactcccggtttaacccgttaggttccggtttacgaaacccgtaccgtaaaacccgtaaaaccgttaccggaccgaaccgtaaagggtaaaccggtttcccgaagggaccaacggtaaccctacccgtaaaccgaaaccggttaaacccgggaccggtaaaaacgttaaaaccgttaaaccggtaaaaccgtaaccgttaaacggtttaaacgtacccggttagggtaacgtacggttaaacggaaccgtacgtacccgttacgtacgtaaccttcggtaacggacggtaacccgtaaccggggttacctttaccgtttaccgttcgttacggtacggtacggtaacgttaacgttaaacgttacgttaaactaccgtaccttacgttaccctttacccttttaccgtacccctttccgtacgttacccgttcgggttacggtacccgtaccggttacccgggtacccccggttacccg

SEQ ID NO: 104184 - DNA, 831 bp, Homo sapiens
  misc_feature: GYAE6OF01E58ZN.17.34.D01.1.454.CMB.1.raw
  modified_base (189)..(189): a, c, t, g, unknown or other
  misc_feature (189)..(189): n is a, c, g, or t
  modified_base (631)..(631): a, c, t, g, unknown or other
  misc_feature (631)..(631): n is a, c, g, or t
  modified_base (666)..(666): a, c, t, g, unknown or other
  misc_feature (666)..(666): n is a, c, g, or t
tcagcgtagactagcacgaccggtgctcgatttagatcgtctgtgttgggttgggacaaaacaaccagattccctcctctaaagaagcccctgggagcacagctcatcaccatggactggacctggaggttcctctttgtggtggcagcagctacgaggtcgtaccacgtcccaggtcctaggttggtnactaagtcgtgggctaggtaggtgaacgccgtccggttcggtccgtggtggacgggtcctccgtgacgtaaggtccgttcgtacggacgtcctaccgttcgagtaccgtaactagtttacgttacgtaaggtttgggaccggccggtaccgggtcccgtacggtacggtaaccgtacggttcgtaggaggtacggaggtagggaaggtccgtaccggttaccgtagttcggtaacgaaccgtaacccgtaacctaaaccgacgaccgtaaacgtaacggtaaccgttaccggaacggtaaccgaaccgtaacccgtacctaaaccgtaaaccggtaacccgtaacggaaaacttaaaaccgtaaacgaaacgttaaccgtaaaggttacgtggtaacgtacgtacgtaacgtacgtcctaacctgtaaccgtagtaaccggnggaaccggtaccgttacgtccgtttataccgggtntacggtacgtaagttaacgttataacttaacgtacctaaccgtttacttacccgtttaccctttaaccccgtttacctacccgtttacggtcccggttaccgttacccgggtaccggtaaccctaccgggttaaccccgtaccccggttccaccccgttaccccg

SEQ ID NO: 104185 - DNA, 557 bp, Homo sapiens
  misc_feature: GYAE6OF01ETWN4.17.34.D01.1.454.CMB.1.raw
  modified_base (335)..(335): a, c, t, g, unknown or other
  misc_feature (335)..(335): n is a, c, g, or t
  modified_base (414)..(414): a, c, t, g, unknown or other
  misc_feature (414)..(414): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagttcaattgggtgcgacgggcctctggacaaggccttggagtggatgggaagatcgtcctatcgttnacacaccaactacgcacagaattcaggcagactcaccataaccgcgaacaaattaacgaacacagttaactcgtagganctagaacagtacctgtacatcgtgaggacacgggtcttcgtacttcgtagtgcgtaggagttaatactactaacacttgtcttacccttttacacccttcccttgtaccttcgtcgggacctacggtcggaaccccggttccg

SEQ ID NO: 104186 - DNA, 834 bp, Homo sapiens
  misc_feature: GYAE6OF01CW8LT.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcgaaggcttcgtggaggccaccgttcagcgactagtgtttacgaagttgggtgaccgacggggtcctacgtggacgtaacggtcccttgggacggttgggagtagggggaacggtacgttcccgttaccgttacgttaccggtttacgaacccgtaaccctaaaccgtaaaaccctaccggaccaacggtaacggtaaaccggtttcccggaaggggtacctaacggtaaccctacctaaaccccgaaacggtaaaccccgggaaccggtaaaacctaaaaacgtttaaacccgaaaaccgtaaacccgttaaaggtttaaaccgttaccggttaaggggaaccgtaaccttaacgggaaaacctacggttcccgttacgggtacctaacgtaccgtacggaacggtacccgtacccggggttctttaaccgttccgtttacgtcggtacggtaccggtaaggttaacgttaacttaacctaataacccgttagtccgttaccctttcccgttttaaacctccccttaccgtttacgttcccgtttacggtcggtacccttacggtaccccgggtaacccctcccgtaccccgttaccg

SEQ ID NO: 104187 - DNA, 611 bp, Homo sapiens
  misc_feature: GYAE6OF01BEWEF.17.34.D01.1.454.CMB.1.raw
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacaggtgtccagtcccaggtccagttggtgcaatctggggctgaggtgaagacgccgtgggtcctcgggtgagggtctccgtgcaaggcttctggaggcaccttcagcgactattagttcaagttgggtgcggacggcctcgtggacaaggtccttgacggtggagtgggaaggatcgtccctatcgttgacacaaccaactacgcacagaactcgaggcagactcaccanaaccgacgacaataacacacagttaanctagganctagaacagcctgtacntcgtgaggaccgacgggtccttacgtacgtttcgtgtacgcggtaagggtacttaagttactaaattacctaacgttcgtccctttacccgttttacctaccccgttccctttacgttaaccgttccggtaccgggttacctacgttacccgggtaaccccccggtacccg

SEQ ID NO: 104188 - DNA, 715 bp, Homo sapiens
  misc_feature: GYAE6OF01CU7AH.17.34.D01.1.454.CMB.1.raw
  modified_base (152)..(152): a, c, t, g, unknown or other
  misc_feature (152)..(152): n is a, c, g, or t
  modified_base (155)..(155): a, c, t, g, unknown or other
  misc_feature (155)..(155): n is a, c, g, or t
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (420)..(420): a, c, t, g, unknown or other
  misc_feature (420)..(420): n is a, c, g, or t
  modified_base (521)..(521): a, c, t, g, unknown or other
  misc_feature (521)..(521): n is a, c, g, or t
tcagcgtagactagcacgaccggtgctcgatttagatcgtctgtgttggggtttggggatcaacaaaacaaccagatttcctcctctaaagaacgcccctgggagcacagctcatcaccatggactggacctggagttcctcttgtggtgcngcngctacgaggtctccagtcccaggtccngttgngcagtcgtgggactgaggtgaacgccggtcgtgggtccgtcgggtggtacggtctccgtgacgacggtcttcgngggacgtcctacccttgacgtcgtaactttgttacgttttanacggttgggaccgtcggaccgggtcctacgtagggacctaaggtcctttaggnggtggagtagggtaacggtcttccgttaccgtatcggtacgaacaaccctactaaactaccganaacgtagtaaccgtcggacgggcaacgtacctaccaacgtaaccgaaccgggaactaacgtaaacgtaacgaaccgaattacgttaacgcgtagaccgtanacgaacgtcgctacgtacagtcggacgtacggacgtacggtcctttacgttacttacggtcgacggtacggtaagttactaacgttacattaaccgtcttaaccgttccttttaaccctttccgtaccctttacccgtacgtttcgttaccggttacgggacccgtttaaccggcccggttaccccggttaccc

SEQ ID NO: 104189 - DNA, 652 bp, Homo sapiens
  misc_feature: GYAE6OF01ADRW8.17.34.D01.1.454.CMB.1.raw
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggacgcaccttnagcgactatagtttcaagttgggtgcgacggcctcgnggacaggccttgagtgngtgggaagctcgtcctagtcgttcgacgacaaccgaaactaccgcacagaacgttccacggganacgacctcaacccgataaccggcggtaacaaacgttaacgaacctaacaagttaaagtctagggagtactacgaacacgcctagttaccagtactacggaacggaccgtacgggtcccttcgttaacgtcgttaggtcggtacgtaagggtaacgttaacttaccgttaaataacctacgtaccgttacctttacccgttttaccttacccgtccctttacgtacgttccggttcgggtaccctggtaacccgggtaccccggcgttacccgtcccg

SEQ ID NO: 104190 - DNA, 727 bp, Homo sapiens
  misc_feature: GYAE6OF01ATQDG.17.34.D01.1.454.CMB.1.raw
  modified_base (137)..(137): a, c, t, g, unknown or other
  misc_feature (137)..(137): n is a, c, g, or t
  modified_base (522)..(522): a, c, t, g, unknown or other
  misc_feature (522)..(522): n is a, c, g, or t
  modified_base (553)..(553): a, c, t, g, unknown or other
  misc_feature (553)..(553): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactgacctggagttcctntttgtggtggcagcagctacgaggtgtccagtcccgaggtcctagttggtgacaatcgtggggctaggaggtaggaagaccgccgtcgggtcccgtcgggtgtacgggttctcctgcgaacggtcgttcgtggacgtcctaccttcacgacgtaacttaagttagttacgtaaggttgggtcggaccggaccgggtcctacgtaggaccgtaacggtccgttggaggtggaggtaggggaaggtactccggttaccgtacgttccggttagaacctaaccaaccgtaacacgaccacgtaacggtaacgttaccgagggaccacgtacctaccgaccaaacgtaacccgacggtaaacctaaactaacgaacacgtaagttaacncgtagagtacctagaactcggacttacgtancgtcgtaggacgtaccgtacgtcttacgtacttcgtacggtacgtacgtaacggtagttaacgttaataaccgttagaccttaccggttccttttaccccttttaaccctccctttacccgttcctacggttcccgtaccgggacctaccggttccccggtaccccggtacccg

SEQ ID NO: 104191 - DNA, 625 bp, Homo sapiens
  misc_feature: GYAE6OF01BRHDV.17.34.D01.1.454.CMB.1.raw
  modified_base (253)..(253): a, c, t, g, unknown or other
  misc_feature (253)..(253): n is a, c, g, or t
  modified_base (572)..(572): a, c, t, g, unknown or other
  misc_feature (572)..(572): n is a, c, g, or t
  modified_base (584)..(584): a, c, t, g, unknown or other
  misc_feature (584)..(584): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcgggtgagggtctccgtgcaaggcttcgngggaggcctaccttcagcgaactatagtttcaagttgggtgccggacgggtcctcgtggacaaggtccttggagtggagtgggaagctcgtcctagtcgtgaccacaccaactcgcacgagtaacgtccgaggtcacgctaccactaacgtaaccggcgaactaaataaccgaactaacgtacgttaactcgtaggacgactaacgaactagacccttgtacctattcggtacggacggtaccgtacggttccttacgtcttcgtggtacgaggtagtacttaattactactaacgtacttgtccttttaccctttacncccctttccgtnttaccgttcggcgggtacctaccggtcccggtacccgtccg

SEQ ID NO: 104192 - DNA, 677 bp, Homo sapiens
  misc_feature: GYAE6OF01AVVC8.17.34.D01.1.454.CMB.1.raw
tcagcgtagactagcacgaccggtgctcgatttagatcgtctgtggttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggtcttcgtggacgcctaccttcagcgactatacgttcaagttgggtgcggacggtcctcgtggaccaggtccgttggacgtggagtaggggaaggtcttccgtacctagtcgttacgaccacaaccctaaacctacgaccaacaggtaacgttccgagggccaggtaaccctcgaaccaacggtaacccgacggaacctaaacgttaacgaacctaacgtaagttaactacgtaggacacgtacggaacacgtaccgtacgtactagtccgaggacggtacgtacgggtcttacctcgttcgtggtacgtacgtaacggtacttaacttacgtaacgtaaccgtaccgttacgtacctttaccttttaccgtacccttccgttacgttaccttcggtaccggtaccgtaccggtcccggtacccccgttacccg

SEQ ID NO: 104193 - DNA, 829 bp, Homo sapiens
  misc_feature: GYAE6OF01AJGAX.17.34.D01.1.454.CMB.1.raw
  modified_base (247)..(247): a, c, t, g, unknown or other
  misc_feature (247)..(247): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgcgtgggtcctcggtgagggtctcctgcaagctctggagcnccttcagcactatagtttcaagttgggtgcgacggcctcgtggacaggcttgagtgagtagggagatcgtcctatcgttacgacacaccaactacgcaacgagaacgttccgaacgggcaacgacctacaaccgacgtaaacccgacggaaactaaaacgttaacgaaacctaacgtaagttaaactacgtagggaacgtacgtaacgaaacgtacgtacccgtacgtaccgtaactaccgtaacggaacgggtaaccggtaccgggttacccgttttaaccgtttacccgtttaccggttacgggtaccgggttaaccggggttaaacgggttaaacggttttaaacccgtttaaagtaaacccgtttaaaacgtaccgtttaacggtttaacccccttttttacccccgttttttttaaaccccttacccccggtttttaccccggttttaaccccggtttaaccccggtttttcccgggttaaacccggggtttacccccggttaaacccggggtttaacccccggggttaaaccccccccgggtttcccccgttaaaccccgggttttaccccccccg

SEQ ID NO: 104194 - DNA, 818 bp, Homo sapiens
  misc_feature: GYAE6OF01D77I9.17.34.D01.1.454.CMB.1.raw
tcagcgtagactagcacgaccggtgctcgatttagatcgtctgtgttgggttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaagaccgccgtgggtcctcggtgacgggtctccgtgcaaggtcttcgtggacgcctaccttcgaggtccgtaacttattacgttcgaagttgggtcgcggacggtcctgtaggaactaggtccttggaggtcggagtacggggaagtcgttccgtaccctagtcgttacgaactaaccgaaccaaacgtcgaccaactaaggtaaccgttaccgaagggaccaacggtacctaccggaaacctaacgtaacccggaccgggtaaaactaaaacgttaaccgaacctaacgtaacgttaacgtaccgtagggacgtaaccgttacggaaaccgacgtacccgtagtacccgtaagttaccggtaaggggaacggtaaccggtcggggttaaccctttaaccgtttaaccgtttccggtaggttaccgggtaacggtaacgggtttaacgttaaaccgtttaacgtaaaccgttaaaccgtaccgtttacggtttaccccctttttaccccttttaaacccgtcccccgtttaccccgtttacggttaccccgttttaccgggtaccggggttacccccttaacggggttacccccggaacccccggtttaccccg

SEQ ID NO: 104195 - DNA, 970 bp, Homo sapiens
  misc_feature: GYAE6OF01D6SWN.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacaggtgtccagtcccaggtccagttggtgcaagtcgtggggctaggaggtaggaagccggccgtgggtcctcgggtggacgggttcctccgtgcgaacggtcttcgtgggacggctaccttcgacgacgtaaccttattacgtttcgtaagtttcggggtcggcggaccgggtcctcgtacgggaacgaacgggttccgtttagggaacggttggggaggttagggggtaacgggtacgtttcccgtttaccccggtttaattccgggtttacggaaacctaacccgtaaaaccccgtaaaaaccgttaccgggaacccaaacgtaaaccgggttaaaccgggtttccccggaaacgggggtaccgtaaaccggtaacccttaaaccccgaaacccccgtaaacggtaaaaaccccccggacccggggtaaaaaccttaaaaaccggtttaaaaccccgtaaaccgtaaacccgtaaaaggttttaaccgtacgggtttaaacgggaccggtaacctaacggaaaccgtaacgggtaccttacggtacctaacgtcgtaacgggacgtaccgggtaccggtttaccctttccgttaacctttccggttacggttagggaacccgggtaaggggtttaacgttaaactttaacgttaaacccgtaaactttacccggtaccgttttacccgttttaacccctttttaaccccgttacccgttttacccccgttaacggtttaccccgtttcgggttaaccccgggtaccggtttaacccggttccccggggttaaccccccgtttaccccgg

SEQ ID NO: 104196 - DNA, 801 bp, Homo sapiens
  misc_feature: GYAE6OF01AK4UY.17.34.D01.1.454.CMB.1.raw
tcagcgtagactagcacgaccggtgctcgatttagatcgtctgtgttgggtttgggatcacaaaacaaccagattcctcctctaaaagaagccccgtgggagcacagctcatcaccatggactggacctggaggttcctctttgtggtggcagcagctacgaggtcgtccacgtcccaggtccgagttggtgactaatcgtgggctgaggtagaacgacgccgtgggtccgtcggtgcggtctcgtgcgaggtcttgtggacgtccaccgttcgagcgacttagttagtttacagttggtcgcggacggtcctgtagacgacggtctggaggtggagtgggaagtcgtccgtccgtagtcgttagaccacaaccgaaccgtacacgaacgtaagtaccgttaccgacggtacacgtaacctaccgaacccgtaacgaaacccggacgtaaacgtaaaacttaaacccggaaactaacgttaaacgtttaactacggtacggtaacgtacgtaaacgaacccgtaccgtaccgtttacgtactacgttaccggtaacggaaccggtacccggtaaccggttccctttaacgtttacccgttaacggttcggtaacggttaccggtaaggttaaaccgtttaaacgttaaaccgttaaaccgttaccttaaccggttacccgtttcccgtttttacccccgtttaacccttacccccgtttacccgtttaacgtcccggtttacccggggttacccggtacccggtttacggtaacccccgggttaacccccgttacccccgg

SEQ ID NO: 104197 - DNA, 665 bp, Homo sapiens
  misc_feature: GYAE6OF01BVKSV.17.34.D01.1.454.CMB.1.raw
  modified_base (247)..(247): a, c, t, g, unknown or other
  misc_feature (247)..(247): n is a, c, g, or t
  modified_base (328)..(328): a, c, t, g, unknown or other
  misc_feature (328)..(328): n is a, c, g, or t
tcagcgtagactagcacgaccggtgctcgatttagatcgtctgtgttgggtttggggacaaaacaaccagattcctcctctaaagaagccctgggagcacagctcatcaccatggactggacctggaggttcctactttgtggtggcagcagctacaggtgtccagtcccaggtccagttggtgcaatctggggctgaggtgaagacgccgtgggtcctcggtgagggtctcctgcaaggtcttcgnggaggcaccttcagcgactatagtttcgaagttgggtgcgacgggtcctcgtggacaaggccttgacgtggagtgggaagntcgtcctatcgttgactacaaccaacgtacgcacgagtacgttccgaggcaacgactcaaccagtaaccgacgaacaaacgttaacgaacactaacgttaactcgtaggacgtctagaactcgtcctgtctactcgtagacggtacgacggtcttactacgttacgtggtacgtacggtaaggtaacgttaacgttaacttaacgtaactaccgttccgtacctttttacccgttttaaccgtacccgtttcccgttacgtacccgttttaccgggttacccgggtacccttaacgggttacccgggtaaccccccggttgtaaccccggtttcccc

SEQ ID NO: 104198 - DNA, 682 bp, Homo sapiens
  misc_feature: GYAE6OF01AG3XL.17.34.D01.1.454.CMB.1.raw
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctctggacaaggccttgagtggatggaagntcgtcctatcgtgacacaccaaactcgcacagaagttcgaggcagactcaccataaccgnggacaaattaccgaacacagttaancgtaggacgactagaactacggtcctagtacctattccgtaggacggtaaccaccggggttcctttacgttaccgttccgttggttacggtaccggtaagggtaacgttaaacgtttaacgttaaacgttaaccgtaaccgttacgtacccttttaccccgtttttaaccgtacccctttacccccgtttcggttaacccgtttccggttaacgggggtaccccttacggttaacccgggtaacccccccgggtttaccgtacccccggtttaccccg

SEQ ID NO: 104199 - DNA, 783 bp, Homo sapiens
  misc_feature: GYAE6OF01DGDZD.17.34.D01.1.454.CMB.1.raw
tcagcgtagactagcacgaccggtgctcgatttagatcgtctgtgttgggttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtcgaaggacgtccgtgggtccctcgggtgagggtcctccgtgcaaggtcttcgtgggacggcctaccttcgaggtaccgtaacgtagttaggtttacaaaggtttcggggtaggccggtaaccggggtcccttcgtacggactaacgggtccgttaggaagtagggagtaggggaagtactccggtaccgtatccggttagacgaccaacccctaaaacgtcgactacgtaacgtaaacgtttcggagggtacgacggtaacctaccgaccgtaacgttaacggacccggtaaactaaaagttaacccggaactaaccgtaaacgttaactacggttacggaacgtactacgaaactacgtaccctagtactaacgtcgtaacggaacggtaccggtaacgggtctttaacttaccgtttacgtacggttggaccggttaggaacgtttaacgttaccgtaaacttaaccgtattaacccggttctttaacccgttttacctaaccccgtttcccgttacgttaccggttcggtccgggtaccttacggttacccggtaacccccggttacgtcccgttacccg

SEQ ID NO: 104200 - DNA, 701 bp, Homo sapiens
  misc_feature: GYAE6OF01C94B4.17.34.D01.1.454.CMB.1.raw
  modified_base (145)..(145): a, c, t, g, unknown or other
  misc_feature (145)..(145): n is a, c, g, or t
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
tcagcgtagactagcacgaccggtgctcgatttagatcgtctgtgttgggtttggggatcacaaaacaaccagattcctcctactaaagaagcccctgggagcacagctcatcaccatggactggacctggaggttcctctttgnggtgcagcagctacaggtgtcagtcccaggtccagttgtgcaatcgtggggctgaggtgaagcgccgtgggtcctcgggngacggtctactgcaggtcttcgnggagctactnagcgatatagttcaagttggtgccgacggtcctgtggaacaaggtcctttaggaggttaggagtacgggaagtcgtcgttcccgtaagtcgtacgtaacaaccgtaaaccgaaacgtaaccgacaaacggaacgttaacggttacccgaagggacctaacggaacttaccgaaccgaaacgtaacccggacggtaaaccttaaaagtaaccgaactaactaagttaacgtacgaggtacgaacgtagaacgacgtctagtcgtactcgtacggagaacgtacggtcctttacgtcgttacgtgtagtacgtaagtaacgttaaagttaaccgtaataaacccgtactacgtttaacctttaccccttttaacgtcccctttacccgttacgttacccgtttggacccgggttactaaccgttcccgggtaaacccccgttccg

SEQ ID NO: 104201 - DNA, 657 bp, Homo sapiens
  misc_feature: GYAE6OF01B4YWP.17.34.D01.1.454.CMB.1.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (469)..(469): a, c, t, g, unknown or other
  misc_feature (469)..(469): n is a, c, g, or t
  modified_base (588)..(588): a, c, t, g, unknown or other
  misc_feature (588)..(588): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaagcgcctgggtcctcggtgacgggtctccgtgcaacggtcttcgnggaggcctaccttcagtcgactatagtttccaagttgggtcncggacgggtcctcgtacggacaaggtccttaggagtcggtagtgggaagtntccgtacctagtcgttgacacacctaactacgcaacgagtaacgtccgaggcagactacaaccgtagtaccgacggtaactaaaacgtacgaacacgtaagttaactcgtaggatcgtagaaccncgtcctagctatcgtagacggtacgacggtcttacttacgtctagggtaccgtagtaacgtacgttaacgttactaaacgtaccgtaccgttacggttaccctttacccttttaacccncccgtttacccgttaggttacccttcgggtaccggtacccttacggtacccgggtaccccccggtaccg

SEQ ID NO: 104202 - DNA, 810 bp, Homo sapiens
  misc_feature: GYAE6OF01C4PZ2.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgacgggtctccgtgcgaagtcttcgtggaggccaccttcagcgactatagtttcaagttgggtgcggacgggtctcgtcggacaacggtccgttaggaggttgggacgttaggggaacggtagttccggttaccccttagttccgttaggaaccaacctaaccaaaacctacgacgaaacgtaacggtaaacggttaccgaacggggacaacgacctaccaaccgaactaaacccgggaccggaaactaaaacgttaaaccggaaaccgtaaccgtaaagtttaaacgtaccgttaaggacgtaccgtaacgaaccgtacgtacccgttacgtaccgtaagttaccgttacggaacgggaaccgtaccggggttcctttaccgtttaacccgttttcgtacggttacggtacgggtaaggttaacgtttaaagtttaaaccgttaataaacccgtacgttaccggttacccttttacccgtttttaaacccgtaccccctttaccccgttttcggttaaccgttttcccggttacgggggtacccctaaccgggttcccgggtaaaccccccggttaacccccgg

SEQ ID NO: 104203 - DNA, 925 bp, Homo sapiens
  misc_feature: GYAE6OF01CGNYK.17.34.D01.1.454.CMB.1.raw
  modified_base (296)..(296): a, c, t, g, unknown or other
  misc_feature (296)..(296): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtcgaagacgcctgggtcctcggtgaggggtctccgtgcgaaggtcttacgtggaggccaccttcacgcgacttagtagtttacaagttggggtcncggtacgggcctacgtgggaccaagggtcctttggaacggttgggaacgttagggggaaacggtacgttcccggttacccgttagttccggtttacggaacctaaccgtaaccccgtaaaaaaaccgttaccgaccgtaaacgtaaacggtaaacgtttaccccggaaggggtacctaaacgggtaaccttaacccgaaacccgtaacgtttaaaaaccccgggacccgggttaaaaaccgaaaaaacgttttaaacccggaaacaaccggttaaacggttttaaacttaccgttaacggggtaactaccggtaagttaaaccgaacggttcccggttaacggttacctaacgtaccgttacgggaaccgggtaacccgttacccgggggtaccttttaccgttaaccgttttaccgtacggttaccgggtaacgggtaacgggttaacggtttaaaacgtttaaccgttaaacgttaaacccttaccggtttaccggttacccttttaaccccttttttaccgacccccttttaccccggttaacgttacccgtttaccggtacggggttacccctaacggtttaccccgggaaaccccccggtttccgtaacccccggtttaccccg

SEQ ID NO: 104204 - DNA, 924 bp, Homo sapiens
  misc_feature: GYAE6OF01CYWRD.17.34.D01.1.454.CMB.1.raw
  modified_base (188)..(188): a, c, t, g, unknown or other
  misc_feature (188)..(188): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtcgtccagtcccaggtcctagttggtncaattcgtggggctgagggtagaaggtaccgccgttggggtccctcgggtggtacgggtcctccgtgacgaacgggtctttcgtgggagcctaccttacgacgtccgtaacttagttaacgttttacgtaaggtttcggggtacgcggaccgggtcctacggtcgggaacgtaacgggtttccgttaggtacgggtaggacgggtaggggaacggttacgtacccgggttacccctttaggttaccgtttacggaacctaaacccgaaacccgtaaaaccgtacggtacccgtaacgtaacgggtaaaccgtttccccggaaggggtacctaaccggtaacctaccccgaaaccgtaacggtaaaccccggtaaaccgggtaaaacctaaaacggtttaaaaacccggtaaaccgtaaccgttaaacggtttaaacgttaccgggtaacggtacggtaaccgttaacggaaccgttaaccggtcccgttaacgttaccgtacgttacggttaacgggaaccggtaaccggttacccggggttactttacccgttaccgtttccggtacggttacgggtaaccggtaagggttaacgttaaacgtttaaacgtaaacttaaccgtaacgtttaccgttaccttttacccttttaaccctaccctttacccggttaccgttaccgttccgggtaaccggttccgtaacccggtacccggttaacccccggttaccccg

SEQ ID NO: 104205 - DNA, 919 bp, Homo sapiens
  misc_feature: GYAE6OF01BNX2C.17.34.D01.1.454.CMB.1.raw
tcagcgtagactagcacgaccggtgctcgatttagatcgtctgtgttgggtttgggatcacaaaacaaccagattcctcctctaaaagaacgcccctgggagcacagctcatcaccatggactggacctggaggttcctcttgtggtggcagcagctacgaggtgtccagtcccaggtccagttggtgcaatcgtggggctggaggtgaagacgccgtgggtcctcgggtgagggtcctccgtgacgaacgggtcttccgtgggacggcctaccttcagcgactaatagtttcaagttcggggtcgccggtacggggtcccttcgtagggaaccgaacggtcccgttaggtacggttagggtaagggttacgggggtaaacgggtacgttacccgggttacccctttaaggtttaccggtttaggaaacccgtaaccaaacccctaaaaccgttaccggaacctaaacgaaacgggttaaccggttacccgaaacggggtaccgtaacgtaacccgtacccgtaaaccgtaaaccggttaaacccggaaaccgggtaaaccttaaaaacggttaaaccgaaaccgtaaacgtaaacggttttaaactccggttaagggtaaacgtaccgttaaggaaacccgtacgacccgttacggttaccaacttccggttaggacccggtaaacgggtaccggggttaccttttaccgttacgtttaccgttcggtaaccggtacggtaacgggttaactttaaacgttaacctaaacgttaaaacctccggtttaacttcccttttaaccccgttttaacccctaaccccggtttaccccttttaccggtaacccgttttacccggggttacggggtaaccccttaaccggttaccccgggggtaaccccccgtttaaccccggg

SEQ ID NO: 104206 - DNA, 717 bp, Homo sapiens
  misc_feature: GYAE6OF01BR2ZI.17.34.D01.1.454.CMB.1.raw
  modified_base (139)..(139): a, c, t, g, unknown or other
  misc_feature (139)..(139): n is a, c, g, or t
  modified_base (252)..(252): a, c, t, g, unknown or other
  misc_feature (252)..(252): n is a, c, g, or t
tcagcgtagactagcacgaccggtgctcgatttagatcgtctgtgttgggtttgggatcacaaaacaaccagattcctcctctaaaagaagcccctgggagcacagctcatcaccatggactggacctggaggttcctntttgtggtggcagcagctacgaggtgtccagtcccaggtccagttggtgcaatcgtggggctggaggtgaagcgccgtggtcctcggtgacgggtctcgtgcgaggtcttcgnggagccacctgagcgactatagtttcaagttgggtgcggtacggccgtcgtggaacgaacggccgtttggaggtggtagtgggaaaggtctcggtaccctagtcgttacgacaccgaccgtaaacctacgaccacgaaggtaacgtccgacgggacgagacctaccaaccacgtacccgacggaacaaacgttaacgaacaactaacgttaatcgtaggtacgacgtacgaaccacgtccgtagtacacgttacgtacggaacggaccgtacggggtaccttccgtttaccgtttacccgtgttcggacgtaacgggttaacttaacgtttaacttaaacgtaccgtaccttacgtttacccctttttacctttaaccccgttccctttacccgttacgttacccggtttacggttaccgggtacccgttaccgggttaaccccggtaccccggttaacccccgg

SEQ ID NO: 104207 - DNA, 781 bp, Homo sapiens
  misc_feature: GYAE6OF01DZMN6.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcgaaggtctcgtggacggctaccttcaggcgactaattagttcaagttgggtgcgacgggcctctggtacaaggtccttaggacgtggagtgggaaggattccgtaccctagtcgttgaaccgtacaaccgtaaactacgacaacgaagtaacgttccgaagggtcaagtacctaccaaccgaaacgttaaacccgaccgggaaactaaaacgttaaaccgaaaccaaccgtaaagtttaacgtacgtacggtagtacctaggaaaccgacggtcccttagtaccgtagttaccgtaggaacgggtaaccggtaccggggttacctttacccttaaccgtttcggtacggttacgggtaccggttaaacgggtaacgttttaaacttaaccgttaaaaccgttaaaccgtaaccgttaccggttaccctttttaacccccgttttttaaaccctaccccgttttacccgtttaccgttaaccgtttaccgggtaccggggtacccctaacggttaccccgggtaaccccccgtttaaccccgg

SEQ ID NO: 104208 - DNA, 859 bp, Homo sapiens
  misc_feature: GYAE6OF01BPS1Q.17.34.D01.1.454.CMB.1.raw
tcagcgtagactagcacgaccggtgctcgatttagatcgtctgtgttgggtttgggatcacaaaacaaccagattcctcctctaaagaagcccctgggagcacagctcatcaccatggactggacctggagttcctctttgtggtggcagcagctacaggtgtccagtcccaggtccagttggtgcaatcgtgggctgaggtgaagacgccgtggtcctcggtgagggtctccgtgcgaacggtcttacgtgggacggtcctaccgttcacggtcggacttacgttaacgtttctaagtttgggtgtccggaccggggtcctcgtaggacgaacggtccgttaggaggtgggaaggttagggggaacgggtaccgtaaaccccgtaacgacggttagggtacgttaccgacgtaacggttcgttaccgtttaccaaccccgttagtaccccggtacccggggaacctaccgggttaacccttaaccccgaacgttaccggaaaccccgtaaacccggttaaaccccttaccccgtaacccgtaaaaccgtttaaaaccccgaacctaaccggtaacccccttaaaccgtaacggtttaccggggttaacggttacgggaacgggtaccgtcccgttaacgggaacctaacgttccgtacggaacccgtaccggtaacggtcccgttacttaacgtttacgtggtacgtacggtacggaaccgtaccccggtaacggtacgttacccgggtagtaacccggtcccggtaacgggtacccggtacgggtacccggttccgtttaccggtaacgttcccggggccggggaaccggttaccgggggtcccgttaacccccggg

SEQ ID NO: 104209 - DNA, 804 bp, Homo sapiens
  misc_feature: GYAE6OF01EEPWN.17.34.D01.1.454.CMB.1.raw
  modified_base (249)..(249): a, c, t, g, unknown or other
  misc_feature (249)..(249): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctggaggtgaagacgccgtgggtcctgggtgaggtctccgtgcaggtcttcgnggacgcctaccttcttagcgtacttagttagtttacaagttgggtcgaccgggaccgggtcctcgtacggaacgtaacggtccgtttagggacggttagggaaggtaggggaaaggtcgttcccggttaccccgttaagttccggttacggaaccctaacctaaaccccgtaaaacgttaccgaaccaaccgtaacggtaaaccggttcccgaaggggacctaacgtaacctaccgaaacccgtaacgtaaacccggaacgtaaaactaaaacgttaaaccgaaaccgtaacgtaagtttaacgtacgtaacggaacgtacgtaagaacctacgtaccgtacgtacgtacgttacgtacggtacggaacccggtacgggttacctttaccgttaccgtttcgttcgggtacgtacgggtaagttaacgttaaacgttactaacgttaacctaacgtttccgttacccttttacccttttaaccctacccctttaccgttacgttaccgtttcggaccgggtacccgtacggttcccgggtaaccccgttaccccg

SEQ ID NO: 104210 - DNA, 834 bp, Homo sapiens
  misc_feature: GYAE6OF01DU2Q1.17.34.D01.1.454.CMB.1.raw
  modified_base (774)..(774): a, c, t, g, unknown or other
  misc_feature (774)..(774): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggactggagttctcttgtggtgcagcagctacgaagtcgcccactcccaggtgcagcgttggtgcagtcgtggggctggaggtgaaggaacgccgtcggggcctcgaggtggaaggtcctccgtgacgtaaggtcgttcgtggtacttaccgtaccgttttaacctccttaagttacgtacttacgaacgtggggtcgccggccgacgggtcccgtacgtacggaaccgtaaaccgtaccgtaggtaacggtagggtaggtcggggtaacggtcggggaacccgtaaacccgtaacgtacggttagggtcgtacgaaccgtagtttcggttccttaacccgtaaccccgtacgttacccggtaccgggggtaaccaaccggttaacctttaaacccgaactttaccccggaacccgttaacccaacccgtttaccctaacccgtaaacttaaaaccgaccctaaaccgtaccctaacgtaaacggttacgggtaaagtttaccgggaaacggtaccgtaccggtaacgtacgtaaccgttaccgtaacggaacccggtaaccggtaccccgggttacccgttaccgtttaacgttaaccggtacggttaccgaccggttaacggcccgtacccgaacggtccgtaccgggngacccgccggtaccggacgtaccgggtcggtcccgtttacggtacgttcggtaccggggg

SEQ ID NO: 104211 - DNA, 723 bp, Homo sapiens
  misc_feature: GYAE6OF01D6PSS.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttggagtggagtgggaggatcgtcctatcgtgacacaccaactacgacacagaacgtcaggcagactcaccataaccgacggaacaaagtaacgaactaactaagttaaactcgtaggaagtacgtaaggaaacctacggtacccttagtacctaacttccgtacggaacgggtaaccgtaccgggtcctttaccttaaccgtttcgtcggtacggtaccggtaaggttaacgttaaactttaacgtaacttaaacctacgttaccggttacccttttaccccgttttttaaaccctaccccgtttacccccgtttacggttaacccgtttccgggttaccgggggttaaccccttaacgggttaacccccggggtaaaccccccccgggtttaccgtaacccccgggttttaccccccg

SEQ ID NO: 104212 - DNA, 699 bp, Homo sapiens
  misc_feature: GYAE6OF01EGMHR.17.34.D01.1.454.CMB.1.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
tcagcgtagactagcacgaccggtgctcgatttagatcgtctgtgttgggtttggggatcacaaaacaaccagattcctcctactaaagaagcccctgggagcacagctcatcaccatggactggacctggaggttcctctttgtggtggcagcagctacaggtcgtccagtcccaggtccagttggtgcaatcgtggggctggaggtgagacgccgtgggtcctcggtgaggtctctgctaagtctgtggngtcncttnagcgtactattacgttacagtttgggcgccggacgggccttcgtacggacgtaacggtccgttaggacggttgggacggtggggaagtccgttccgttacccttaggttaccgttacgaaccaacaacccgtaaactaccgcaacgtaacggtaacgttccggaggactagacctacgaccacgtaaccggacgaaacctaaagtaaccgaactaacctaagttaacgtacggtaggactacggtacgaactacgtcccgttacggtactcgttacggtacgaacgtaccgtaccggttccttacgttacgtcgtacggttaccgaggtaacgtaacgttaataacgtaacgttacacgttcgtcccttttacctttaacctcccgttctacggtactttccgggacggtaccgttaccggtcccggacccgtttcccg

SEQ ID NO: 104213 - DNA, 938 bp, Homo sapiens
  misc_feature: GYAE6OF01C8P28.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtcgtccacgtcccaggtccaggttggtgcaatcgtggggctggaggtagaagaccggccgttcgggtccgtcggtggacggttctccgtgacgtaaggtccttcgtagggacggtcctaccttcgagacgtaacttagttagttttacgtaagtttggggtacggccggaccgggtccgtcggtacgggaaccaacgggttccgttaggagggtaggtaggtagggggtaacgtacgttccggttaccccgttagtaccggttacgaaacccgaacccgtaacccgtaaaaccgttacgaaccctaacgtaaacggtaaccggttacccgggaacgggtaccgaaccgtaacccctaacccgaaacccgtaacgtaaaccccggaaacggaaacctaaaacgttaaacccgaaacgtaacgttaacgtttaacgtaccggtaggtaacgtaccgaaacgtaaaccgcgtacccgttaagttccaacgtttccggaacgggtaaccgggtacccggtaaccggttacctttaaccggtttaacccgtttcggtttacgggaccggttaacgggttaaacgggttaactttaaaacccggtttaaacttaacgttaaaccccgtttacggttaccgtttttacccctttaacccccgttttttaacccgtaccccccgttttacccgttttacggtttaccccgttttacccgggacccggggtttaaccccttaaccccgggttacccccgggtaacccccgggtttaaccccccg

SEQ ID NO: 104214 - DNA, 970 bp, Homo sapiens
  misc_feature: GYAE6OF01CD86K.17.34.D01.1.454.CMB.1.raw
  modified_base (188)..(188): a, c, t, g, unknown or other
  misc_feature (188)..(188): n is a, c, g, or t
  modified_base (260)..(260): a, c, t, g, unknown or other
  misc_feature (260)..(260): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggacggttcctcttggtggtggcagcagctacaggtcgtccagtcccaggtcctaggttcggngctaatcgtggggctaggaggtcgaagcgccgtgggtcctaggtgacgggtctccgtgactacggtcttcgnggacgtcctaccttcgagcgtacttagttacgtttacgaagttcggggtacgccgggtaccggtcctacgtacgggaactaacgggtccttaggagtacgggtcgtaggggtaaacgtccgtaccgttaccgttagtccgttacgaaacctacccgaaccgtaaaacctcggtactaacggtaacgttaaccggtaccgaacggtaccgtaacgtaccctaacgaacccgtaaacgttaaacccggggaaccggtaaaactaaaaaccggttaaacccggtaaaccgtaaccgtttaaggtttaaccgtaccgggttaacgggtaaccgtaacccgggtttacggaaaaacccggttcccggtaaccccgtttaggtaaaccccgttaggtaacccgggttaacgggtaaccccgggtaacccggggtttaaccgggtttaacccgttttaccggtttaacccggtttacgggtaaccgggttacgggttaacgggaaaccgggttttaaacgtaaacccggtttaacgttaaaccgttaaccggttacccggtttaccggttttaaacccccgttttcccgttttaacccctaacccggttttccccggtttaacggttaaccccgggtttaccgggtaccggggttaaaccctttacccggggaaacccccggtttaaccccggttacgttacccccccggttaaccg

SEQ ID NO: 104215 - DNA, 978 bp, Homo sapiens
  misc_feature: GYAE6OF01CUMOW.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacgaggtgtccacgtcccaggtccagttggtgctaagtcgtggggctaggacggtgaagaccgtccgttgggtccctgggtggtacgggtcctaccgtggacgaacggtcgtttcgagggacgcctaccttacgacggtaccgtaacttagttaagtttaccgtaaggtttggggtcgacccgggtacgggtcccttacggtacggtaacgtaaccgggtccttagggtaggtacgggtaacggtaggggtaacggtacgttcccggttaccttacgttccggtttaacgaaccgaacccaaaaccgtaaaccgtacgaaccgtaaacgtaaacgggttaaccggttacccggaaagggtacccgtaaccgtaacccgtacccgaaaaccccgtaaacggttaaaaccccggtaacggtaaaaaacccgttaaaaaccggtttaaaacccgggaaaacccttaaacggttaaaggttttaaaccgtaccggggttaaacggtaaacggtaacgtaaccggtaaacgtaacccggtaccgtttaacggttacctaaccggtttaacggtaacgggaaccgggttaaccgtaaccggggtttcccgttttaaccgttaccggtttaaccgttggttaacggggtaaccggttaaagggtttaacgttaaacgtttaaacccttaaaccgttaacgttaccggtttaaccgttttacccccttttaacccggttttaccccctaccccgttttacccgttaaccgtttcccgttacgggtaccccggtagttaacccccgggttcccggtaacccccgttacccg

SEQ ID NO: 104216 - DNA, 931 bp, Homo sapiens
  misc_feature: GYAE6OF01CHU24.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacgaggtgtccagtcccaggtccaggttggtgcaatcgtggggctggtaaggtgaaggacgcccgtggggttcccgtcgggtggaggggttcctccgtggcgaacgggtcctttcgtagggtacggcctaccgttacgacggccgtaaacttattaacggtttacctaaaggttggggtaacgtccggtaaccggggtccgttcgtagggtaaaccgtaaacggggtccctttagggagggttacgggaacggttcgggggtaaaacgggtcgttaccccgggttccccttaaggtcccggtttacgaaaacccgttaaccgaaccctaaaacgttaccggacctaacgtaaacggttaaacgttccgaaaggggacccaacggtacctaaccaaacgaacggttaaacccggaccggtaaactaaaacgttaaaccgaactaaccgtaaggtttaactcggttaaggaacgtacgtaacggtaaaccgaacggtcccttacgtaaccgtacgttaccggttaggaacccgggtaaccggtaaccgggtacctttaccgttaacggtttcgtacggttaccggacggttaacggttaagttaaaaccttacgttaaaaccgtaaaccgtttaacgttaccggtacccttttttaaccccttttaacccggtaacccctttaccccgtttaaccgggttacccttttacccgggttaaccgggggtacccccttaaacgggttaccccccgggtaaccccgggttaacccccgg

SEQ ID NO: 104217 - DNA, 810 bp, Homo sapiens
  misc_feature: GYAE6OF01CR3CN.17.34.D01.1.454.CMB.1.raw
  modified_base (260)..(260): a, c, t, g, unknown or other
  misc_feature (260)..(260): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacgaggtgtccagtcccaggtccagttggtgcaatcgtgggctggaggtgaagaccgccgtgggtcctcgggtggagggttcctccgtgaccgaaggtcttcgngggacggcctaccttgacgtccgattagtagtttaccgaagtttggggtcgccggaccggtcctcgtacggaaccgtaacgggtcctttaggaggttaggaggttacggggaaggtacgttcccggttaccccgttaagtccggttagaaccaaccgaaacccgtaaaccgttcgaaccgaacgtaacgtaaccggttaccgagggtacaacgactaccgaaactacgtaaacccgacggaaactaaacgtaacgaaacctaacgtaagttaactacgtaggtacgactaacgaacctacgtaccgttacgtacgtacgttacgtacggtacggtaaccgtaccgggttaccttacgttaccgtttccggtagtacgtaacggtaaggttaacgttaaacgttaacgttaactaaaccgtaccgtttacgttcccgttttaccctttttaaccccgtaccccgtttaccccgtttacggttacccggtttaccggttacccggggtacccttaacccgggttaccccgggttaacccccggttaccccgg

SEQ ID NO: 104218 - DNA, 965 bp, Homo sapiens
  misc_feature: GYAE6OF01ACOER.17.34.D01.1.454.CMB.1.raw
  modified_base (160)..(160): a, c, t, g, unknown or other
  misc_feature (160)..(160): n is a, c, g, or t
  modified_base (182)..(182): a, c, t, g, unknown or other
  misc_feature (182)..(182): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggagttcctctttgtggtggcagcagctacaggtntccagtcccagtccagttggtncaatcgtggggctggaggtgaacgacgtccgttgggtcctgggtgtacgggttcctccgtgacgtaacggtcttcggtagggacggcctacctttcgagtccgtaacttagttacgttttaccgaagtttggggtcgccgggtaccggggtccttacggtgggaaccgtaacggtcccgttagggacgggttagggagttaggggtaacggtacttacccggtacccttagttcggtttacaacctaaccgaaacccgtaaaccgtaccggacctaaacgaacggttaacggttacccggaacggggtacctaacggtaacccttaccgaaccccgtaaacggtaaaccccggacggtaaaaccgttaaaaacgtttaaccccggaaaactaccggttaaaacgtttaaacgtccggtaacggggtaaccgtaacccgttaaacggaaacccgtaacccggtttacccgttaacgtaaccgttaacggtacccggttaaagggaacccggggttaacccggtaacccgggtttacccttttaacccggtttaccgtttaaccgggttcgggtaacgggttaaaccggggaacggtttttaaacggttaaacccgttttaaacggtaacccgttaaaaccgtccgtttacccggttaaccccttttttaacccgttttaacccgtaccccctttacgggtttacccgtttacccggtaccgggttaccgggtacccctaacgggttacccccgggaaccccgtttccgaaccccggtttacccg

SEQ ID NO: 104219 - DNA, 1014 bp, Homo sapiens
  misc_feature: GYAE6OF01DTV5C.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctccgtgcgaaggtcttcgtggacggtcctaccgttcgacgcgacttaagtacgttttacaagtttgggtgccggaccgggtcctcgtggaccgaagggtccctttagggaggttggaacgtagggggaacgtacttcccggttaccctagttaccggtttacgaaccgtaacccgaaaccttaaaaccgtcccgaaccgtaaacgtaacggtaaaccggtttacccgaaggggtaccctaaccggtaacccttacccgaaaacccgtaaacggttaaacccccgggacggtaaaacccgttaaaacgttaaaacccgtaaaaccaaccggtttaaacgtttaaacgttcccgttaaggggaacgttacgtaaaccgggtaaaccaccggttacccgtttcggttaacctacgttaccggttaacgggaaccgggtttaacccggacccggggtttccttttaaccccgttacgtttttaccgggttacgggttaccgggacgggtttaaacggggttaagttaaaccggtttttaaacccgttaacggttaaaaaccccgtttacccgtttaaccggggttttaacccccccttttttttaaaaccccgtttttttaacccccgttaaacccccccgttttttacccccggttttaacccgggttaaccccgggttttttaaccccgggggtaccccggggggtttaaacccctttaaaccccccggggtttaaaccccccgggggggtttaaacccccccccgggtttaaccccccgg

SEQ ID NO: 104220 - DNA, 681 bp, Homo sapiens
  misc_feature: GYAE6OF01BFRVZ.17.34.D01.1.454.CMB.1.raw
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggacgttcctctttgtggtggcagcagctacaggtgtccagtcccaggtccagttggtgcaatcgtggggctgaggtgaagcgccgtgggtcctggtgaggtctctgcaagtcttcgnggngcgtaccttcgagcgactattagttntaagtgggtgcggaccggcctgaggacgaggccttggagtggagtgggaagctccggtcctagtcgttcgacacgtaaccaaacgtaccgacaacaagaacgttacgaggacacgactaccaccaaacgtaaccggacggaaactaaaacgtaaacgaactaactaagttaactcgtaggacgtaccgtaagaacgacgtaccgtcgtaccagttacgtagaacggtaccgtacgggtacctttcgttaacgttcgttacggtggtacgggtaagttaacgttaatttaacgttaactaaccgtacttacgttacccttttaccttttaaccctacccttcccgtttcgttaccgttccgggtacgtacccttacgggtaaccccggtaccccgtccgtcccgttacccg

SEQ ID NO: 104221 - DNA, 937 bp, Homo sapiens
  misc_feature: GYAE6OF01B8S9D.17.34.D01.1.454.CMB.1.raw
  modified_base (128)..(128): a, c, t, g, unknown or other
  misc_feature (128)..(128): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggnggttcctctttggtggtggcagcagctacaggtgtccagtcccaggtcctagttggtgcaatcgtaggggctggaggtagaaggacgccgtgggtccgtcgggtggacgggttcctccgtgacgtaacggtcttcgtagggacggacctacccgttcgacggtccgtaaacttacgtttaacggttttaccgtaaaggtttcgggggtacgaccgggtaccggggtcccttaccggtgggaaccgtaacggtcccgttaggggtaacggtaggggtacggtagggggaaacggttaccgttacccggttcccgttaacggttaccggtttaccggaaacccgtaaaccgtaaaacccctaaaaccgtaaccggaacccgtaaccgtaaaccggttaaacgttacccgggaacggggtactaaacccggtaacccgttaaacccgaacccgtaaaccggttaaaccccgggaaaccggtaaaacccttaaaaaaccggtttaaaacccgaaaccgtaaccgtttaaacgtttaacgtaacgggtaacgggtaacgtaccgtaaacggtaacgtaacgtacccgttacgtacctacgttaccggaggtaccgggtacggtaccggttaccgttacctttacggtacgttacggtacgggtaccggagttaacgttaaacgttaacgtaaccctaacgttaccgttaccgttaccctttaaccccgtttttcctaccctttccgtttacgtaccgttcggtaccggtaccgtacggtacccccggtaaccccggttcgtaccccgttacccg

SEQ ID NO: 104222 - DNA, 810 bp, Homo sapiens
  misc_feature: GYAE6OF01CNVO6.17.34.D01.1.454.CMB.1.raw
  modified_base (102)..(102): a, c, t, g, unknown or other
  misc_feature (102)..(102): n is a, c, g, or t
  modified_base (323)..(323): a, c, t, g, unknown or other
  misc_feature (323)..(323): n is a, c, g, or t
  modified_base (555)..(555): a, c, t, g, unknown or other
  misc_feature (555)..(555): n is a, c, g, or t
tcagcgtagactagcacgaccggtgctcgatttagatcgtctgtgttgggtttggggatcacaaaacaaccagattcctcctactaaagaagcccctgggancacagctcatcaccatggactggacctggacggttccttctttggtggtggcagcgagcttacaggtcgtccacgtcccaggtccgtaggttggtagcaagtcggtggggctaggtaggtagaacggaccgtccgtgggtaccgtgggtggacggtcctcgtagacgagtcttcgtgggacgcctacctcgagtcgtacttagtagttcgtagttcgggtnccggtacggtctcgtacggacgtacggtctaggagtaggaggtgggacgtcgtaccgtcctagtcgtacgacaaccgaccaacgtcgacacgtagtaacggtaccgaggtccgaacgtaccacgtaaccgtaaccggtaaccggaaccggtaaacgtaaacgttaaaccggaaaccgttaacttaacggtttaacgtaccgggttacggtactaaccggtaacgtaacccgngtttacccgtagtaacacggttaccgagggtaaccgggtacccggttcggttaccctttacgtttaccgtcggtaccggtaggtaaacgttaaccgggttaatttaacggttaaaccgttaccgtaaaacccgtttccggtaacggttttaacccccttttcccgtttaaacccctccgttttaccccgttaggttaaccccgttcggggtacccggttaccgtacccgggtaacccgggtccccggttaacccg

SEQ ID NO: 104223 - DNA, 653 bp, Homo sapiens
  misc_feature: GYAE6OF01BK8S4.17.34.D01.1.454.CMB.1.raw
  modified_base (188)..(188): a, c, t, g, unknown or other
  misc_feature (188)..(188): n is a, c, g, or t
  modified_base (380)..(380): a, c, t, g, unknown or other
  misc_feature (380)..(380): n is a, c, g, or t
tcagcgtagactagcacgaccggtgctcgatttagatcgtctgtgttgggtttggggatcacaaaacaaccagattcctcctctaaagaagcccctggggagcacagctcatcaccatggactggacctggaggttcctctttgtggtggcagcagctacaggtgtccagtcccaggtccagttggtncaatcgtggggctggaggtagaagacgccgtgggtcctcgggtggagggtctcctgcaggtcttcgtggcgcctaccttcgagccgactatagtttcaagttgggtgcggacgggcctcgtggacaggtcctgaggtggagtggggaaggtagtcgtacccgtagtcgttagaccacacccgaaactaccgnaacgtagaacgttaccgacgggtacacgacctaccaccaacgtaacccgacggaactaaacgttaaaccgaaccaacgtaacgttaaacgtactaggacgacttacgaacacgtcctgtacatcgaggacgtacgacggtcttctacttctggtagtcggaggtacgttaattactaataaccacgttacgtcctttccgtttaacctcccgttacccttcgttaccgtttcggtacgggacctaccggttccgggtaacccccgttacccgg

SEQ ID NO: 104224 - DNA, 570 bp, Homo sapiens
  misc_feature: GYAE6OF01AUDV3.17.34.D01.1.454.CMB.1.raw
  modified_base (378)..(378): a, c, t, g, unknown or other
  misc_feature (378)..(378): n is a, c, g, or t
  modified_base (524)..(524): a, c, t, g, unknown or other
  misc_feature (524)..(524): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacggcctcgtggacaaggtccttgagtggagtgggaagatcgtccctatcgttgacaccaaccaaactacgacacagaagttccaggcagcncaccataccgcgacaaactaacgaacactagtaatctaggacgctagaacacgtcctgtacatctggacggaccgacggtccttactacttcgtacgtcgacgaggtagttaattactaataacctactgtccttaccttttaccncccttcccttgtaccttcgtacgggaccacgtccggaccccgtccg

SEQ ID NO: 104225 - DNA, 811 bp, Homo sapiens
  misc_feature: GYAE6OF01DR3UQ.17.34.D01.1.454.CMB.1.raw
  modified_base (642)..(642): a, c, t, g, unknown or other
  misc_feature (642)..(642): n is a, c, g, or t
  modified_base (795)..(795): a, c, t, g, unknown or other
  misc_feature (795)..(795): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggacggttccttctttggtggtggcagcagctacgaggtcgtcccacggtccccaggttcccgtaggttgggtgactaacgttccggtgggggtcctggagggtaggaaacggccggtccggttcggggttccgtcgggtggtacgggttccttccgtagtacgaaggtccttcggtcgggacgcctaccttcgacgtcgtaacttagtttacgtttacgtaaggttcgggtcggaccggtaccgggtccttcggtacgggtaaccggtaacgggtccgtttagggtacggttaggggtacgggtagggggaaacggttccgttacccggttacccgttagttaccggttaccgaaccaacccgtaaacccgtaaaccgtaccgaccgtaacggtaacgtaaccggttacccgggaacgggtaccaaccggtacctacccgtaaacccgtaaccgtaaccccgggaaacggtaaaccttaaacgtaacccggaacttaacgtaacggtttaacnccggtaaggaacctccgtaagaaccgtcgaccgttgacctagtccggtacgacggtaccgtcgtacttcgtacgttgtagcggagtagttaatacttaacactacgtctactccttttaaccttactcccgtcttagtccctacggtccgtanccgttcccggccctcc

SEQ ID NO: 104226 - DNA, 645 bp, Homo sapiens
  misc_feature: GYAE6OF01AZU5E.17.34.D01.1.454.CMB.1.raw
  modified_base (571)..(571): a, c, t, g, unknown or other
  misc_feature (571)..(571): n is a, c, g, or t
  modified_base (601)..(601): a, c, t, g, unknown or other
  misc_feature (601)..(601): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacccgcttaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgttggacacggaacccttggtccttccgggcgacggccgggtccttttcgacccgtctttactcgtttacttatcgtcagcatttccgctacttctgacttaccctcagctatcgccctacacacgccacctaccttcacctaggtaccttacgacgtaacccgccctaccccctaacccaacgaaccgcaactaacggccgtaccgcctacggccctactacgtccttcgggtcncgtacgttcgggtttaccgtccccgtttcnccttcccttacccgcctacttcctagtaccgttcgtccgtaccg

SEQ ID NO: 104227 - DNA, 665 bp, Homo sapiens
  misc_feature: GYAE6OF01EHYO8.17.34.D01.1.454.CMB.1.raw
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (599)..(599): a, c, t, g, unknown or other
  misc_feature (599)..(599): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcatcgtggggctgaggtgaagacgccgtgggtcctcgggtgagggtctcctgcaaggcttcgtgggaggcaccttcgagcgacttattagtttcaagttgggtgcgacgggcctgtcggacgaggccttggnggtggagtgggaagtntcgtcctatcgtnacacaccaactacgcacgagaacgtccgaggacagactcaaccacgtaacccgcggaaactaaacgtaacgaactaacgtaagttaactccgaggaacgtacgtaacgaaacctacgtccgtactaccgtatcccgtaggaccggaaccgtcgggttcctttaccgtaacgtttcgtcgttacgggacgtaaggttacgttaaacttactaaacgtaacctacttacggttcccttttaaccttttacccncccgtttccgttacgtaccgtttcgggtaccgggtacctaccggtcccgggtaaccccggttcccg

SEQ ID NO: 104228 - DNA, 869 bp, Homo sapiens
  misc_feature: GYAE6OF01BT5CQ.17.34.D01.1.454.CMB.1.raw
tcagcgtagactagcacgaccggtgctcgatttagatcgtctgtgttgggtttggggatcacaaaacaaccagattccctcctctaaagaagcccctgggagcacagctcatcaccatggactggacctggagttcctctttgtggtggcagcagctacaggtgtccagtcccaggtccagttggtgcaatcgtggggctgaggtgaacgacggccgttgggtcctcgggtgacgggtcctccgtagacgtaaggtctttcgtaggtactttaccgtaaccggtttaacccttcccgttaagttaacggtaattacccgtaaaaaccggtttcgggggttacgacccggtacccgtaaacggggtacccccggtacgtttaaccgggggaaaccctaaaaacccgggaccccggtttaacgggtaagggtttaccggggtaaaggtttacgggggggtaacgtttaccggggggaacccctaaaaaccccccgttaaagtaccggtttacgggtacgtaaccacgtaaggttccgtaccgtttacccgaacccgtacgttcccggtaacccggggatacggtaaccttaacccgagtaccgaaaccccaacgtaaccctccctaaccaaagttaaacccactacgaactaactaagtacggtaacgttggaacggtacgacccgtaggaactagtacctaacggaaccgtacgccggtaccttacttaagttaccgtcgtacggaccggtaacgaccgttacccgaacggtccgtaccgggtagacccggtaccggtaaccggcgtaccggtccgttaacccgttttaggaacccggtttcgggtacggggaaccctggggtaaccccg

SEQ ID NO: 104229 - DNA, 740 bp, Homo sapiens
  misc_feature: GYAE6OF01CRBLK.17.34.D01.1.454.CMB.1.raw
  modified_base (193)..(193): a, c, t, g, unknown or other
  misc_feature (193)..(193): n is a, c, g, or t
  modified_base (227)..(227): a, c, t, g, unknown or other
  misc_feature (227)..(227): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacaggtgtccagtcccaggtccagttggtcgcagtcgnggggctagaggtgaagcgccgtgggtcctcgggngacgggtctccgtagaccgtaaggtccttcgtagggacggacctaccgttcgacggccgtaacttaagttaaggttttcgaaaggttttggggacgaccgggtaccggggtaccttcggtacgggaacgtagggtccgttaggaggtggaaggtagggaagtcgtaccgttcctaagtcgttacgacaactaaccaactcggactaacgaggtaacgtccgagggtacagtacaccgaaccaacgtaaccgacgaataaactacgaacaacgtagttaatagtacggaatacgtacgaacgacgtacctaggtacctagtcgacggtacgaacggtacggtacctttacgtttacgtcgtacggttagaacggtaaggttaagttaacttagtaactaaaccgtacttaccgttaccgtttaaccctttaccgtaccctttaccgtccgtttaacgtccgttacgggtaccctaaccgggttacccgtaacccggtcccttacccgttacccg

SEQ ID NO: 104230 - DNA, 657 bp, Homo sapiens
  misc_feature: GYAE6OF01EIQ5Y.17.34.D01.1.454.CMB.1.raw
  modified_base (98)..(98): a, c, t, g, unknown or other
  misc_feature (98)..(98): n is a, c, g, or t
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
  modified_base (447)..(447): a, c, t, g, unknown or other
  misc_feature (447)..(447): n is a, c, g, or t
  modified_base (550)..(550): a, c, t, g, unknown or other
  misc_feature (550)..(550): n is a, c, g, or t
tcagcgtagactagcacgaccggtgctcgatttagatcgtctgtgttgggtttggggacaaaacaaccagattcctcctctaaagaagcccctgggancacagctcatcaccatggactggacctggacggttcctctttggtggtggcagcagctacaggtgtccagtcccaggtccagttggtgcaatcgtggggctaggnggtgaacgacgtccgtcgggtcctcgggtgagggttcctccgtgcgtaaggctttcgaggcggctaccttcgagcgtactatagtttcaagttggtcgcgacggctgtggacaacggtctgacgtggagtgggaagtctcgtccgtatcgtgaacacaaccaactccgnacgagacgtcgaggactagactcaacacgtaaccgcgaaactaagttaacgaacacgtaagttagacgtggtaanccgtagaactacgtccttagtactacgtacgtaggaccgtacgtacggttccttagtaccttcgtgtacgacgtagtaacgttaactaacttactaaaccgtnttcgttaccctttaccgtttaacctccctttacccgttcgttacccgttacggtaaccgggtctaacccgggttaccggtaaccccggtccgtacccgttaaccccg

SEQ ID NO: 104231 - DNA, 799 bp, Homo sapiens
  misc_feature: GYAE6OF01C4IZC.17.34.D01.1.454.CMB.1.raw
tcagcgtagactagcacgaccggtgctcgatttagatcgtctgtgttgggtttgggatcacaaaacaaccagattcctcctctaaagaagcccctgggagcacagctcatcaccatggactggacctggacgttctcttgtggtgcagcagctacaggtcgtcagtcccagtccagttggtgcaagtcgtggggctgaggtagaacgacgccgttgggtcctacgggtgtagggtcctaccgtgacgaaggtccttcgtaggacggtcctacccttgacggtcgtaacttagttagtttccgaaaggtttggggtacgaccggaccgggtaccttccggtaggaacgtaacgggtcctttaggaggttagggagtaacggggaaacgtctccgtaccgttagtccgtacgaacctaaccgaacgtaaacctcgactagaacgtacgtccgaggacagactacaacacgtaaccgacgtaactaaacgtaacgaacacgtaagttaacgtacgtagacgtacgtaacgaacgtacgtaccgttcgtacacgttacgtacgaaccgggtaccgtaccggttaccttacccgttacgtttaccggttggtaccggtaacgggttaacggtttacgtaaacttttaaaccgtaaacgtaaaccctttacggttaacccggtttaccctttttaaaccccgtttttaaccctaccccgttttaaccccggttacgttaacccgtttaccggtacccggggtaccctttaacccgggtaacccggttaaccccccggtttacccg

SEQ ID NO: 104232 - DNA, 830 bp, Homo sapiens
  misc_feature: GYAE6OF01DKFDN.17.34.D01.1.454.CMB.1.raw
  modified_base (347)..(347): a, c, t, g, unknown or other
  misc_feature (347)..(347): n is a, c, g, or t
  modified_base (431)..(431): a, c, t, g, unknown or other
  misc_feature (431)..(431): n is a, c, g, or t
tcagcgtagactagcacgaccggtgctcgatttagatcgtctgtgttgggttggggatcaacaaaacaaccagattcctcctactaaagaacgcccctgggagcaacagctcatcaccatggactggacctggaggttcctctttgtggtggcagcagctacaggtgtccagtcccaggtcctagttggtgcaagtcgtggggctggaggtgaacgacgcccgtgggtcctcgggtggacggtctctgacaggtctgtggacggctacctgacgcgaacttagtacgttttcgaagtttgggtcgcggaccggtctacgtcggtaacaagggtccttggaggtgggngttaggaaggctaccgttctattccggtagaccaacctaacaaacgttacgacaacgtagtaaccgttcgaacggcaagacccncgtaaacccacgtaaaccggtacgaactaaacgttaaccgaaactaacgtaaggttaaaccgtcgtagggacgaccgttaaagaaccggtacgtccgtacgtacacgtttccgttagggacggtaacccgtacgggggttaccctttaacgtttaccctttacggggttacggttacgggtaccgggtaaaggttaacgggttttaaaccggtttaaaaccttaacgggtttaaaacccctaggttacccccgttttaaaccttttttaccccccgtttttaaccggtaccccttttaaccccggtttcggttaaacccgtttttacccggggttaccccgggggtttaccccgtaaccgggttaacccccccgggggttaaccgtttaaccccccggg

SEQ ID NO: 104233 - DNA, 776 bp, Homo sapiens
  misc_feature: GYAE6OF01BZL51.17.34.D01.1.454.CMB.1.raw
  modified_base (144)..(144): a, c, t, g, unknown or other
  misc_feature (144)..(144): n is a, c, g, or t
  modified_base (189)..(189): a, c, t, g, unknown or other
  misc_feature (189)..(189): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgnggtggcagcagtctacgaggtgtccagtcccaggtccagttggtncaatcgtgggctgaggtgaagacgccgtgggtcctcggtgaggtctcgngcgtaagcttcgnggagctacctnagcgtatatagttcaagttggngcgacgtctcgtggaacagtcttgaggtggacgtagggaagtntccgtcctagtccgttgaaccacaaccgaaacncaccgtaagagtaacgtccgacgggataacacctataaccgataacccgtacgaaactaaaagttaaccaactaacgtaagttaactacggtaaggacgtacgtaacgtaacggtaccgtacgttaccgtagttaactacgggtaacgtaacggaccgttaacggtccgtttaacgttaccgtttaccgtagggtaccggttaaccggttaaggttaaaccgtttaacgtttaaaccgtaaaacgtttaaacccttaaccggttcccgttttaaacctttttaaccccccggttttttaaaccgtaaccccttttaccccgggtttaccgttaaaccggttttcccgggttaaacccccgggttaccggttaaaaccccggtttaccccggggtaaaaccccccggtttccccggg

SEQ ID NO: 104234 - DNA, 754 bp, Homo sapiens
  misc_feature: GYAE6OF01DTFYB.17.34.D01.1.454.CMB.1.raw
  modified_base (248)..(248): a, c, t, g, unknown or other
  misc_feature (248)..(248): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggacggttcctctttgtggtgcagcagctacgaggtgtccagtcccgaggtccagttggtgacatcgtgggctgaggtgaagcgccgtggtcctcggtgcggtctctgcgaaggtcttgnggacgctaccgtcgagcgtacttagtagtttacgaagttgggcgtacggacggtcctcgtacggacgtaagtccgttagtaggtacggaggtacggggaacggtacttaccggtaccgttacgtacgttacgaccgaaccgtaaccaaaccttcgaacacgtaacgtacgtaccgaggacaacgacctacgaaccgtaagtaaccgacgtaactaaacgtaacgaactaacgtaagttacgtacgtacggtacgtacaacggtaactacgtaccgtacgtacgtacgtccgtaacggtaacggtaacggtaccgggttcctttaccgttacgtttcggttacgtacgggtacggtaagttaacggttaaacttacttaaaccgtacctaccgttaccgtttaccctttacccgttttaaccctaccccgtttaccggttaaccgttacccggtttacgggtaccggtaaccgttacccggttcccgggtaacccccggtttacccg

SEQ ID NO: 104235 - DNA, 749 bp, Homo sapiens
  misc_feature: GYAE6OF01AGUY2.17.34.D01.1.454.CMB.1.raw
tcagcgtagactagcacgaccggtgctcgatttagatcgtctgtgttgggtttggggatcaacaaaacaaccagattcctcctctaaagaagcccctgggagcacagctcatcaccatggactggacctggacggttcctctttgtggtggcagcagctacgaggtgtccagtcccaggtccaggttggtgacaagtcgtgggggctggacggtaggaacgaccggtcccgtggggttccctcgggtggacggggtcctccgtcgcgaacggtctttcgtggtacttaccgtaccgttttacctaccgtaattagtactccgaacgtggggtcgccgaccgaggcccgcgtacggtaaccaaccggtaccgtacggaagggttacggaggtaggggaacggtcggggaacccgtaaacccgtaacgtacgttgggtcgttacgacgtacggttacgttcctaaccaccctcgtcccgcgggaacacgtaacctacactacgaccctacgtacctccctacaacacacgactcactgtaggagtagacggactcgtacacgtactcgacgaccgaccgtaccggtaccgttacgttacgttaccgtaggtccgaacggtaccggtaacccgtacccggtaggtaccgggttacccgtaggacccgtaccgggacccggtcggtacccggttccggttacgtttacggtaccgtttaccggggtccgggggaaccggtccggggtacccgg

SEQ ID NO: 104236 - DNA, 672 bp, Homo sapiens
  misc_feature: GYAE6OF01D0RMP.17.34.D01.1.454.CMB.1.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
tcagcgtagactagcacgaccggtgctcgatttagatcgtctgtgttgggttggggatcacaaaacaaccagattcctcctctaaagaacgcccctgggagcacagctcatcaccatggactggacctggaggttcctctttgtggtggcagcagctacaggtggtccagtcccaggtccagttggtgcaatcgtggggctggaggtgaagaccgccgtgggtcctcgggtgagggtctcctgcaaggtcttcgtggacgcctaccttnagcgtactagttagtttcaagttggncggacggctnaggacacgactggagtggagtggagtgggacctaaccgtanacgtggtactcacgtgtntcctccacctactccgacgaccagtacttacngtacacccagtaacctcccacctaataaccactacgacctacagtaggtagtaggacggactcccgtagactactacgtacgaaccgggccgtcgggtacccgttaccgttacgttaccggtagtcgtaccgtacggacccggtaaccccgtacggtaaccgttcccgggtaacgtccggtaaccccggtacggtacccggtacggtcccggttaccccggttttcgaacccgggtttccgggttaccccgggggccgtacgggggttacccccgg

SEQ ID NO: 104237 - DNA, 697 bp, Homo sapiens
  misc_feature: GYAE6OF01EOPPE.17.34.D01.1.454.CMB.1.raw
  modified_base (296)..(296): a, c, t, g, unknown or other
  misc_feature (296)..(296): n is a, c, g, or t
  modified_base (618)..(618): a, c, t, g, unknown or other
  misc_feature (618)..(618): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttggtggtggcagcagctacaggtgtccagtcccaggtccagttgtgcaatcgtggggctgaggtgaagacgccgtgggtcctcgggtgagggtctccgtgccgaaggtcttcgtaggaggcctacttcgagcgaacttattagtttcaagttgggngcggaccggtcctcgtggacgaaggtccgttggagtggagtagggaaggactccgtcctagttcgttacgaacctacgaccaaacgtacgcacgagtaacgtcgagggacagacctcaacctagtaaccgcgaactaaactacgaacatagttaactcgtagacgtctagaaccgacgtacctcgtactacgttcgacggtacggtaaccgtcggggttcctttaccgttacggttaccgttagtacggtacgacgggtaagtttaaacttacttaacgttaaaccgtacgtttaccgttacccttttacccgttttaaccncccccggttttaccttcggttaccccgtttacggttaccgggacccttaacgggttaccccggaccccgggttaacccg

SEQ ID NO: 104238 - DNA, 889 bp, Homo sapiens
  misc_feature: GYAE6OF01CO6QN.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgccgtgggtcctggtgagggtctctgcgaaggtcttcgtgggacggcctaccttcgacgacgtacttattagttttacaagtttgggagccggaccggggtccttacgtcgggaacgtaacggtccttaggacggttggacgttaggggaaaggcgtttccggttacccgttaagttccggtttacggaacccgtaaacctaaaccccgtaaaaccgttacggacctaacgtaaacggttaaaccggtttcccgggaaacggggtacctaacgggtaacccttacccgtaaaaccccgtaaccgtaaaaccccggggtaccgggtaaaaaccttaaaaaccggttttaaaacccggaaaaccgttaaaccgttaaacgttttaaaccgtaccgttaacggggtaaacggtacccgttaaacgggtaaaccgtaaccgtacccgtttcggtaacctaacgttaacccggtacgggtaaacgggaacccggttaacgggggttccctttaccggtttaacccgtttacgttacggttaccgtacgggtaacggttaacgttaacgttaactaacgtaacctacgttacgtaccctttacccgttttccgtaaccctttccgttcgttacgttcccggtacggtaccctacgtacccggtaaccccgttccgtacccgttcccg

SEQ ID NO: 104239 - DNA, 803 bp, Homo sapiens
  misc_feature: GYAE6OF01B89J5.17.34.D01.1.454.CMB.1.raw
  modified_base (196)..(196): a, c, t, g, unknown or other
  misc_feature (196)..(196): n is a, c, g, or t
  modified_base (268)..(268): a, c, t, g, unknown or other
  misc_feature (268)..(268): n is a, c, g, or t
  modified_base (459)..(459): a, c, t, g, unknown or other
  misc_feature (459)..(459): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggntggaggtgaagcggccgtgggtccgtcggtggagggttctccgtggcaaggtcttcgtggaggccaccgttnagcgacttagttagtttcaagttggggtcgacggtacgggtccttgtacggacaaggtccgttaggacggtggtaggtaggggaaacggtcgttccggtacccttagtaccggtttcgaaccaaccgtaacctaaaacgtaccgaccaaccgtaagtaaacggttccccgaaggggaccaacggtaaaccncccgtaaaacccaaaccgttaaacccggaccggtaaaacctaaaaaacgttaacccggaaactaaaccggtttaagtttaaaccgtcggttaacgggtaacgtacgttaaacggaacgtacgtaccgtcgttactaacggttccgacgggtaacgacccggttaacgggttacctttaccgtacgtttacggtggtacgtacgggtaagttaaaggttaacttacgtaactaacgacctttcgttaccttttacccgtttaccctacccttccgttaacctcggtttccggccgggttacccaacggttaccccgggaaccccgttccgacccgtttaccccgg

SEQ ID NO: 104240 - DNA, 797 bp, Homo sapiens
  misc_feature: GYAE6OF01D945S.17.34.D01.1.454.CMB.1.raw
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctggaggtagaagaccgccgtgggtcctcggtgacgggtctcctgcgaaggtcttcgtggaggcctaccttcgagcgactatagtttcaacgttgggtgcgtaccgggccttcgtggacaacggtccttgaggttggagtaggggaaggtactaccgttccctaactcggtttagacctacaacccaaaacgtaccgctaaacgagaacgtttcccgaaggggtccaacggaccttaccgacccaacgttaaacccggccgggtaaaactaaaacgtttaaaccgaaacctaacgtaaacgttaaactccgttaagggaacgtactacggaaacctcggtacctagttaccacttccgaggtaacggacctacggggtcctttaccgtaaccgttccgttaggttaccggaccggtaaggtaaacgtttaaatttaaacccgttaagttaaaccccgtaccgtttaagggtaaccccttttttacccccgtttttaacccgttaccccttttaccccggtttaacgttaccccggttttcccggttacggggaccctttaaacccggttacccggggtaaaccccccccgtttaccccggg

SEQ ID NO: 104241 - DNA, 639 bp, Homo sapiens
  misc_feature: GYAE6OF01BK5HR.17.34.D01.1.454.CMB.1.raw
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggtcctcggtggagggtctcctgcaaggtcttctgggacggctaccttcagtgactatacgtttcaagttgggtgcgacgggcctntggacaaggccttggacgtggagtgggaagtntcgcctatcgttgaccacaaccaaacgtacgacacaagaacgttccgagggacagacctcaaccgacgtaaaccgcgaactaaacttaaccgaacactaagtaactcgaggtacgactagaacacgtcctagtacgactcgtaggaacgtaccgcgggtccttaccttaccgttcgtacgtcggtacgaaggtagttaacttactattaaaccacgttacgtcctttaccttttaaccctcccttcccgttagttacccgtttcggtacgggtaccctaggttacccggtaaccccggttacccg

SEQ ID NO: 104242 - DNA, 940 bp, Homo sapiens
  misc_feature: GYAE6OF01C4JL2.17.34.D01.1.454.CMB.1.raw
  modified_base (284)..(284): a, c, t, g, unknown or other
  misc_feature (284)..(284): n is a, c, g, or t
tcagcgtagactagcacgaccggtgctcgatttagatcgtctgtgttgggtttggggatcaacaaaacaaccagattcctcctactaaagaacgcccctgggagcacagctcatcaccatggactggacctggtacgttcctcttgtgggtgcagcagctagaggtcgtaccacgtcccgaggtccaggttggtgacaagtcggtggggctaggaggtagaacggaccgccgttgggtccgtcgggtaggtacggttcctccgtggacctaaggtccttacggngggaacggtcctaccgttacgacgtacgtacttaacgttagtttaactaaggttcgggtacggtaccggtaccgggtcctacggtacggaaccgtaacggttaccggttaggagggttagggtaagggttaacggggaacggttacgttacccggttaccgttaagttaccggtacaaccaaccgtaaaccaaaccggtaccgaaccgtaactaaccgggtaaccgtttacggaacggtaccgaacgtaccgtacctaaccgaacggtaaaccgaacggaaaccgtaaactaaaccgtaaacctaacgtaaagggtttaacacgggttacgggaagtacggtaaaccgacgtaccggtacttacgttaaccgtacgtaccggttaaggacccggtaacgggtacccggttttacgttacgtttaaccggtttacggtaccgggtacgggttaaacggttaacgggtttaaaacgttaaacgtttaaacccgttaaagtaacccgttaaccggttaccgttttaacccccttttaacccgttttaacccccgttaaccccggtttaccccgttttaaccggttaccgttttacccgggaaacccggggtttcccccgaaaaccgggttccccccgggtttaaacccccggtaacccg

SEQ ID NO: 104243 - DNA, 782 bp, Homo sapiens
  misc_feature: GYAE6OF01APKMT.17.34.D01.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
  modified_base (185)..(185): a, c, t, g, unknown or other
  misc_feature (185)..(185): n is a, c, g, or t
  modified_base (272)..(272): a, c, t, g, unknown or other
  misc_feature (272)..(272): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (766)..(766): a, c, t, g, unknown or other
  misc_feature (766)..(766): n is a, c, g, or t
tcagcgtagactagcacgaccggtgctcgatttagatcgtctgtgttgggtttggggacaaaacaaccagattcctcctctaaagaacgcccctgggagcacagctcatcacatggactggacctggagttcctntttgnggtgcagcagctacaggtcgtccagtcccaggttccaggttggtncgaatcgtgggcttaggagtgaagcgtcgtcgggtctacgggtgacggtcctccgtagcaaggtcttcgtggacgtcctccgttacngtacgtaccttagtacgtttacgtaagttcgggtcgtcggaccgggtcctcgaggactaacgggtccttaggagttggacgtgggaaacggttctaccgtcccgtatcggtnaaccgacaccgaagtaccganaacacggaacgttcgacggcaccggaactccaaccgtaaaagtaccccggtagaaaccctaaaacgttaaaccttacgaacttaacggttacgtacctagggtaactacgttaacgaaacgtccgtaacccgttacgtagtaccgtaccgtagggaacctaacgggtacccggtaaactttcgttaacgttcgtaggtttacccgagggtaaacgttaacgtttaaactacgggtttaaaccttaaacaccggttttcggaaccccttttaccggtttaacccttccccgtttaaccttcggaccccgggttttaacctcccggggtaacccttacggggtaaaccccttaccccggggtntttaaaccccgtcccg

SEQ ID NO: 104244 - DNA, 819 bp, Homo sapiens
  misc_feature: GYAE6OF01DSZFV.17.34.D01.1.454.CMB.1.raw
  modified_base (146)..(146): a, c, t, g, unknown or other
  misc_feature (146)..(146): n is a, c, g, or t
tcagcgtagactagcacgaccggtgctcgatttagatcgtctgtgttgggtttggggatcacaaaacaaccagattcctcctactaaaagaacgcccctgggagcacagctcatcaccatggactggacctggagttcctctttgnggtgcagcagctacgaggtcgtccacgtcccaggtcctagttggtgcaagtcgtggggctggaggtgaacgacgtccgtgggtcctgggtggacgggtctccgtgacgaggtcttacgcggacggtcctaccgttcgacgtaccgtaacttacgttacggtttactaaggtttcgggcggtaccggacgggtccctacggtacgggaaccgtaacggtccgttaggtaggtcgggaggttacggggaaggtctacccggtaccgttagtacggttacaaccgtaaccgaacctaaaccgtacgaaccgtaacgtaacggtaaccgtccgacgggactaacgacctaccgaactaacgtaaccggaacggaactaaacgtaacgaactacgtaacgttactacgtaaggacgtactaacgaaccgacgtcgtacgtactagtaccggtagggaaccggtaccgtaccgggttacctttacgttaccgttcgtagggtaccgtaaccggtaaggttaaccgtttaactaacccgttaacgtaaaccgtaccgtttccgtttaccccttttaacccgttttaacccctacccgtttaccccgtttaagttaccccggtttccgggtaccgggtaacccctttaacccgggttaaccccgggtccccgttaccccgg

SEQ ID NO: 104245 - DNA, 649 bp, Homo sapiens
  misc_feature: GYAE6OF01CRS9V.17.34.D01.1.454.CMB.1.raw
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggactggagttctcttgtggtgcagcagctacgaggtgtccagtcccaggtccagttggtgcaatcgtggggctagaggtgaagcgccgtgggtcctcgggtgcggtctctgacaggtcttcgnggacgctcctnagcgactatagttcgaagttggcgcggcgggtcctgtggacgaggtccttggagtggagagggagacgtcgtcctagtcgtacacacaacctaacgtacgacaacgacggtaacgttcgaggcacgacctacaaccgaacgaacccggacgaaacgtaaactaacgaaactaacgtacgttaactacggtacgtaacgtactacgaaccgtacgtccgttagtaccgtatcgtaacggtcggaaaccgtcgggttacctttccttacggttgtcgtggtacggaagttagttaacttactaacgtactcgttacgttcctttaccctttaaacctccctttaaccgtcttaccgttcggacggttcctaccggtacccggtcccggtaccg

SEQ ID NO: 104246 - DNA, 741 bp, Homo sapiens
  misc_feature: GYAE6OF01E1Q2G.17.34.D01.1.454.CMB.1.raw
  modified_base (259)..(259): a, c, t, g, unknown or other
  misc_feature (259)..(259): n is a, c, g, or t
  modified_base (524)..(524): a, c, t, g, unknown or other
  misc_feature (524)..(524): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggaggttccttctttgtggtggcagcagctacgaggtgtccagtcccaggtccagttggtgacaagtcgtggggctggaggtgaagacgccgtgggtcctgggtgacggtctccgtgcgaaggtcttcgngggacgcctaccttcgagccgtaacttattaacggtttcaaggtttggggcgaccgggtaccgggtcccttacgtacgggaacctacgggtcctttaggaggtgggagtacgggggaaagtcgttccgtacccttagttcggttacgaccaacctaaccaaacgtaccgactaacgagtaacggttccgagggcaacgacctacaaccaacgtaccgacgaaactaaactaacgaacaatagttaactcgtaggagtcagaaccncgtcctagtacagttaccgaggaacggaccgtacgggttcctttacgtactttcggtcgtacggacgtaaaggtactttaagttaaccgtaacgttaaaccgtaccgttacggttttacccttttacccgttttaacccaccccgtttcccgtttagttacccggtttccgttaccgggaccctttacgggttaaccccgggtccccgtttaacccg

SEQ ID NO: 104247 - DNA, 942 bp, Homo sapiens
  misc_feature: GYAE6OF01BZ24Q.17.34.D01.1.454.CMB.1.raw
tcagcgtagactagcacgaccggtgctcgatttagatcgtctgtgttgggtttggggacaaaaacaaccagatttcctcctctaaaagaacgcccctgggagcacagctcatcaccatggactggacctggaggttcctctttagtggtggcagcagctacgaggtgttccacgtcccgtaggttccgaggtttgggtgactaagttcggtgggggctaggacgggtaggaaacgtaccggccgttcgggggttcccgttcggggttaggtaccggggttcccttccgtcggaaccgtaagggtccgtttcggcgggtaacggtcctacccgttacgacgtacggtaacttaactttacggttttaacgtaacgttggggttacggaccgggtaccggtcccgttacggtcggaacggtaaacggttccgttggtaaggtagggtaagggtaggggtaaacggtcgtacccggttcccgttacgttacgtacgtaaccaaccgtaaacccaaacgtacgaccgaacgaacgtaacgttcggacggtacacgacctacaaccgtaacgtaacccggacctaaacgtaaaaccgtaaacgtaacctaaacgttaacgttaaacgtacggtacggtaacgtacgtaacgaacgtaacgtaccgtcgttaccgtaacgttacgacggtaaccggtaccgggtaaccggttccgtttacgttacgtttacggttacggtacgggtaacggttaaacggttaaacgttaacgttaaccggttaaacttaaacccgtaccgtttacccgttacccccggtttttacccttttaaccccgtttaacccgtttccccggtttacgtaacccggtttccgggtacccgggttaacccgttacgggttaacccccggttaaccccggttaccccggtaccccgtttacccccg

SEQ ID NO: 104248 - DNA, 735 bp, Homo sapiens
  misc_feature: GYAE6OF01DMF8C.17.34.D01.1.454.CMB.1.raw
  modified_base (101)..(101): a, c, t, g, unknown or other
  misc_feature (101)..(101): n is a, c, g, or t
  modified_base (142)..(142): a, c, t, g, unknown or other
  misc_feature (142)..(142): n is a, c, g, or t
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
  modified_base (271)..(271): a, c, t, g, unknown or other
  misc_feature (271)..(271): n is a, c, g, or t
  modified_base (479)..(479): a, c, t, g, unknown or other
  misc_feature (479)..(479): n is a, c, g, or t
tcagcgtagactagcacgaccggtgctcgatttagatcgtctgtgttgggtttgggatcacaaaacaaccagattcctcctctaaagaacgcccctgggancacagctcatcaccatggactggacctggagttctcttggnggtgcagcagctacaggtcgtccacgtcccgaggtccaggtttggtcgacaagtcgnggggcctggacggtgaacgcgccgttcgggtccgtgggtcgacgggttccncgtcggacgtaggtcttcggnggacgcctaccgtcgacgtcgtaaccgttagttacgtttacgaaggtttcggggtacgtcccgggaaccgggtccttacggacgggtaaccgtaacgggttccgtttggacgggtaggggtaggtaacggggtaacgtccgttccgtaccccgttagtacggttacaaccccaaacgacctaaacgtcgacaaccgtagtaacgtcgnggacaacgtcccacaaacgtaacggacccgtaaataaaccgtaaataacgaactaacgttaagttaacgacgtacgaagtactaacggaacctcggacctaggtaccctagttaccgagtacggtacgccgttaactttacgtacgttcgcgacgacgtaagttacgtaattacgtaacgactcggttcttacccctttattaccctaccttccttagttacgtccgtacggtccaaccgtcccgtaccgtacccg

SEQ ID NO: 104249 - DNA, 797 bp, Homo sapiens
  misc_feature: GYAE6OF01BZKNK.17.34.D01.1.454.CMB.1.raw
  modified_base (135)..(135): a, c, t, g, unknown or other
  misc_feature (135)..(135): n is a, c, g, or t
  modified_base (502)..(502): a, c, t, g, unknown or other
  misc_feature (502)..(502): n is a, c, g, or t
tcagcgtagactagcacgaccggtgctcgatttagatcgtctgtgttgggtttgggatcaacaaaacaaccagattcctcctctaaagaacgcccctgggagcacagctcatcacatggactgactggagttctnttgtgtgcagcagctacgaggtcgtcctaagtcccgaacggtccgagttcggtgcaacgtcgtggggacttggaggtagaacgcgtcgtgggtcccgtaggtgtacgggtcctcgtacgacaaggtcttcgaggtacggcctacttacgacggacgtaacgttagttacgtttacgtaaggtttggggtacgtcgggtaaccgggtcccttacggtacgggtaaccggtaaacggttccgttaggtacggttaggaacggtaaggggtaacggtaacgttcccggtaccgtttaagtacggttacggaaacctaaccgtaaccgtaaaacctacgacaacgtagaaacgtcgaggtacacgacctanacgaacgtaaccgacggtaactaaacgtaacgaacgtaataacgtaactacgtaggtaacgtacgtaacgtaaacgcgtataccggtactacgttacgttaacggaacggacggtaaccggtccttacgtacttacgtacgttacggacggtaagtaacgtaaccttaacgtaacgtaaccgtaccgttacgttccgtttaacctttaacccttacccgtttaccccgttaacttttaccggtaccgggtaccgttaaccggtaccccggttaaacccggtacccgttaaccccg

SEQ ID NO: 104250 - DNA, 931 bp, Homo sapiens
  misc_feature: GYAE6OF01AD8ZN.17.34.D01.1.454.CMB.1.raw
tcagcgtagactagcacgaccggtgctcgatttagatcgtctgtgttgggtttggggagtcacaaacaaccagattcctcctctaaagaagcccctcgggagcacgacgctcatcaccgatggacgtggacctggacggttcctctttggtggtaggcgagcagtctacaggtgtcccagtccgaggtccagtttggtcgctaagtcgttgggggcttaggacggtgaaacgaccggccgttggggtcccttggggtcgaaggggttcctaccgtgccgtaaacggtctttccgaggggacgtcctaaccttcgacgtcgaacgtaagttacgtttcgaaacgtttggggtacgtaccggtacggggcccttcggtaacgggttaaccaaagggggtccccgttttaggaaccggggttacgggtaaggttaaccggggggaaagggtaaccgttcccggggtttaacccctaaacggtttcggttttaccggaaaaccggttaacaaaccccccggtttaaaaagttaacccggacggaaacccgttaagggtaaaaccgggttttaccccgaacggggttaacccgaagtttaacccgttaaccccgggaaaccttaaacggtaaacccccggggttaacggaacccggttaaaaaacgttaacgggtaaaccctaaacgtaaaccgtttaaacgttacgttaacgggtaacgtaacgttaggaaccgtaacgggttactaccgtacgtacgtcgttaacggacgacgtaacgggtccttacgtaccttcgtcgtacgtacggaacgtagtaacgttacgtactaaaccgtcgttacgtacctttaccttttaaccgtccctttaccccttacggttaccctccggttaacggttcccgtaacgttaccgggtccccggtttaacccgg

SEQ ID NO: 104251 - DNA, 803 bp, Homo sapiens
  misc_feature: GYAE6OF01B85CB.17.34.D01.1.454.CMB.1.raw
  modified_base (142)..(142): a, c, t, g, unknown or other
  misc_feature (142)..(142): n is a, c, g, or t
  modified_base (149)..(149): a, c, t, g, unknown or other
  misc_feature (149)..(149): n is a, c, g, or t
  modified_base (200)..(200): a, c, t, g, unknown or other
  misc_feature (200)..(200): n is a, c, g, or t
  modified_base (279)..(279): a, c, t, g, unknown or other
  misc_feature (279)..(279): n is a, c, g, or t
  modified_base (450)..(450): a, c, t, g, unknown or other
  misc_feature (450)..(450): n is a, c, g, or t
  modified_base (581)..(581): a, c, t, g, unknown or other
  misc_feature (581)..(581): n is a, c, g, or t
  modified_base (591)..(591): a, c, t, g, unknown or other
  misc_feature (591)..(591): n is a, c, g, or t
tcagcgtagactagcacgaccggtgctcgatttagatcgtctgtggttgggtttaggggaacaaaacaacccagattccctcctactaaaagaacgcccctgggagcacagctcatcaccagtgactgacctggagttcctnttgtggnggcagctagctacgaggtgtcccgagtcccgtacggtccgtaggttgggtnaccaatcggcggggtactgggtaggtagaacgacggtccggtcgggttacccgtcgggtacggtacgggttcctaccgnggaacgacggttcttcggagggacggtcctaccgttacacggtactaaccgttagttagttacgtaaggtcgggtacggccgggaccggtcctacggtacgaaccggtaggttaccgttaggaggtaggtaaggtagggaaccgtacgtccggttaccgtagtaccggtanaaccctaaccgaaacctaaccgacgacctaacgaacggtaactacccgggacgacaacgacgtaccaacgtaaccgtaacggaactaacaaaacgtaaccgaactacgtaactaagtcgtaacggacgtanaacggaaccncgtacgtactatacggacgtacgacgggtacgacggtttaccttacgttaccgtagttcgggtagtaaccgtaaggttaccttaacggtataaaccgtacttaccttacgtttacccttaacctttaccgtacccttaccgttcccgttaacgtccgggtaccggttaccaacccggggttaccctaaccccggtccgttacccgttacccg

SEQ ID NO: 104252 - DNA, 1009 bp, Homo sapiens
  misc_feature: GYAE6OF01DU680.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtcgtccagtcccaggtccagttggtgcaatcgtggggctggaggtagaagaccgccgtgggtccgtcgggtgacgggttctccgtgcgaacggtccttcgtaggacggtcctaccgttcgagtccgtaacttagttaacgttttaccgtaaaggtttcggggtcgaccgggtaccgggtcccttacggtacgggaaccgtaaacggggtcccgtttagggagggttagggaacggttacggggggaaaggttaccgttcccggttaacccccgtttaggttaccgggtttaccgaaaacccgtaaaccccgtaaaacccgtaaaaaaccggttacccggaaaccgtaaaaccgtaaaacgggttaaaaccccgggtttacccggaaaccgggggtaacccgtaaaccggtaaccccgtaacccgtaaacccccgtaaaacggttaaaacccccggacgggttaaaaacccttaaaaaacccggttaaaccgtaaaaccctaaaaccggttaaacgttttaaaccggtaaccgggttaacgggaacgttaacccgtaaacggtaaaccgtaccgggtacccgtttagtaccgtaacgttacccggtaacggtaaccgggtaaccggtaacccgggttacctttaaccgttaccgtttacgttacgggtacggtaacggtaagggttaacgttaaacgtttaaccgtaaagttaaacccgttacgtttaacccggtttacccctttttaacccgtttttaaccctccccgttttaccccgttacggttaccccgtttacggtacccgggtacccttaaccggtaccccgggtaacccccgttaccccg

SEQ ID NO: 104253 - DNA, 919 bp, Homo sapiens
  misc_feature: GYAE6OF01A47SW.17.34.D01.1.454.CMB.1.raw
  modified_base (338)..(338): a, c, t, g, unknown or other
  misc_feature (338)..(338): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgctaagtcgtggggctggaggtgaacggaccgtccgtgggtccctgggtgtacggggttcctccgtgacgtaagggtcctttacggtgggacggacctacccgtttacgacggtccgtaaccgttagttaacgttttccgaaagtttcgggggtanacccgggaccggggtccctacggttagggaacctaacggtaccgtttaggaacggtgggtaacgtaggggaacgtacgtccggttacccgtaagttcggttacgaaccgacctaaaccgtaaaccgtccgactaacggtaacgtaacggttacccggaacgggtacctaacgaacccttacgaacccgtaacgtaaacccggtaacggtaaacccttaaaacgtaaccgaactaacgttaacggttaaactccggtaaaggtacgttaaccaacggtaaacccgtagtaccccggttaatcccgtaaggttaccgtacgggtaacgggtaaccgttacggggttaacttttcccggtaaccttaccgggttagtaccgggtacggttaaacgggttaactttaagttacccgtaaacgttaccgttaaccgttacggtttaaccccttttacggttttaaacccctaccctttaccccggttaacggttaacccccggtttcgggttaacccggggtaccctttaaccgggttaacccccccgggggtttaaacccttccgttaacccccgggttaccccg

SEQ ID NO: 104254 - DNA, 734 bp, Homo sapiens
  misc_feature: GYAE6OF01CHCDV.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgcctgggtcctcgggtgagggtctcctgacgaaggtcttcgtggacggccaccttcacgcgtaactattagtttacgaagttgggtgccggaccgggtcctcgtggacgtaacggtccgttagaggtggagtggggaacggtactccgtccctagtcgttacgaccaaccgaaccaaacctacgaccaactacggtaacgttccgacgggacacggtacctacgaacccaacgtaaacccggacggaaacctaaaacgttaaaccgaaaccgtaacgtaacgttaaacgtcgtaacgggtacgtaacgtaacggaaccgacgtaccgttacgtactaacttcgtaggaaccgggtaaccgtaccgggttactttaccttaccgtttacgttcggtggtaaccggaggttaagttaaacgttaactaaactaccgtacttacgttaccttttacccttttaccgtccccttacccgttactaccgttcggtacggtacctacggttaccggtacccggttacccg

SEQ ID NO: 104255 - DNA, 719 bp, Homo sapiens
  misc_feature: GYAE6OF01A6BOC.17.34.D01.1.454.CMB.1.raw
  modified_base (326)..(326): a, c, t, g, unknown or other
  misc_feature (326)..(326): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccagttggtgcatctggggctgaggtgaagcgccgtgggtcctcgggtgaggggttctcctaggcaaggcttcgtggaggccaccttcagacgactatagtttcaagttgggtgcgacgggtcctcgtggacgaaggtccttggaggnggacgtggggaagggacttccggtccccttagttccggttagacctaacaacccaaaccgtacgacaacgagtaacgttcccgagggtcaacggacctaccgaacccaacgtaacccggacggtaaccaaatttaaaccgaacaacgaagtttaaacctacgtacgtaacgaccgtaacggaaacacgtacctgtacgtacttcgtaggtacggacgttacggtaccttaccttcgttccgttaggttacggacgttaacggttaacttaaacgttactaaacgttaaccgtaccgttcttcccgttttacttttaccctacccgtttacctttaccgtaccgtttcggttaccgggaccttaccgggtacccgggtacccccgttaccccgg

SEQ ID NO: 104256 - DNA, 700 bp, Homo sapiens
  misc_feature: GYAE6OF01A7WLV.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggtcctcgggtgaggggtctccgtgcaaggcttctgggaggcaccttcagcgactatagttttcaagttgggtgccggacggggtcctctggggacaaagggccctttaggacgttggatgggaaggatccgtcctatcggttgaacctacacctaaactacgccaacagaacgtttcccgaagggcacgtacctcaacccataaacccggcgaaactaaattaaccggaacaacgtaagttaaactcgtaggacgtacgttacgaacacggacctcgtactatcgtacgacggacgtacgggtaccttcgttacttacgtcgtcggacgtaaggtagttaacgttaactaacgttaacgacttacgttaccgtttacccgtttttaaccgtacccctttacccggtttcgtacccgtttacgggttccggggtacccttacggttacccgggtaaacccccgggttaccgtaacccggtttccccg

SEQ ID NO: 104257 - DNA, 686 bp, Homo sapiens
  misc_feature: GYAE6OF01ASB80.17.34.D01.1.454.CMB.1.raw
  modified_base (505)..(505): a, c, t, g, unknown or other
  misc_feature (505)..(505): n is a, c, g, or t
  modified_base (594)..(594): a, c, t, g, unknown or other
  misc_feature (594)..(594): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctctgcaaggtcttcgtggacggctaccgttcgagccgaacttattagtttcaagttggggtcgacggacgggcctcgtggacctagggtccttggacggtggagtgggaaggtgttaccgtccgtagttcgttacgaacctacgaacctaaacgtaccgacaaccgagtaacggtccgaagggccagtaacccacaacgtaacgtaaccggaccgaaacctaaaattaacccgaaccaacgtaacgttaactacgtaaggacgtactagaaccngtacctgtatactcgtacggacggaccgaccggttcttaccttacgttcgttagtcggtagtaacggtaattaattaccgtagttaccncttacgttacctttaccccttttaccgtacccctttacccgtcgttaccgttccggtaccgggtcctacgggttacccggaccccggttacc

SEQ ID NO: 104258 - DNA, 1049 bp, Homo sapiens
  misc_feature: GYAE6OF01CWWT8.17.34.D01.1.454.CMB.1.raw
tcagcgtagactagcacgaccggtgctcgatttagatcgtctgtgttgggtttggggatcacaaaacaaccagattcctcctactaaagaagcccctgggagcacagctcatcaccatggactggacctggaggttcctctttggtggtggcagcagctacaggtgtccacgtcccaggtcctagttggtgactaatcgtgggggactggaggtacggtaacggaccggccgttcgggtcccgtggggtacggtacggggttccttccgtggtacgaaagggtccgtttcggtcggggaacggtcctacccgtttacgacggtaccggtaactttaacggttagttttaaccgtaaacggttttggggtaccggtaccggacccggggtaccgttaccggtaccgggaaccggttaaccggggttaccgttttaggggaggttaaggggtacggggttaacgggggtaaacggggttaccgttaccccggtttaccccgtttaacggttaccggttaacggtaacccgtaaaacccgtaaaaccccgtaaaaccgttaccggaaaccgtaaaaccggtaaacgggtaaacccggtttacccggggaaaccgggttaccgaaccggtaaacccgtacccgtaaaacccgtaaacccggtaaaacccggggtaaaccggttaaaaccgtaaaaacccgtttaaaacccggaaaacccgttaaaccggtttaacgtttaaaccggttacggtaacgggtaaccgtaacgtaacccggtaaccggtaccgtaccggtttaacgtacccgttaagttaccgtaacgggaccgtaccgggtacggtttacccgtttctttaaccgtttacggttcggtacgggtaccgggttaaaggttacgttaaaaccgtttaacgtaaaccttaaacccgttaccgtttaccggtttaacccttttaacccgttttaacccttaccccgtttaccgtttaccgtttcccggttacggtacccggtaccgttaacccgggtacccggttacccggttaccccg

SEQ ID NO: 104259 - DNA, 827 bp, Homo sapiens
  misc_feature: GYAE6OF01EL3L6.17.34.D01.1.454.CMB.1.raw
  modified_base (244)..(244): a, c, t, g, unknown or other
  misc_feature (244)..(244): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtggtcctcggtgagggtctcctgcaggctntggagcacttcgagcgactattagttctaagttgggtgcggtaccggggcctcgtcggacgaacgggtcctttggagggttacgggagttgggggaaacggtattccggttaccccgtagttcggttacgaccaaccaacccgaaacctaccggacaacaaggtaacggttccgaacggggtccaaggtaacctacccaaccacgtaaacccggaccggtaaactaaaacctttaaacgggaaaccctaacctaaacggtttaaattcccgtaagggtacgtaccgttaaagaacccgtacgtccccttaggtacctaagttccgttcggaaaccgggtacccggaaccggggttacccttttaccgttaacccgtttaccgttgggttaacggtacggggttaacgtaacggttttaaactttaaaccgttaaaccttaaaccgtaaccgttttccggttaacccttttttaaccccgtttttaacccctcccccttttaacccccgtttggtacccttttcccggggtaacgggggttcccctaaccgggtttccccggggaaaccccccgggtttccccg

SEQ ID NO: 104260 - DNA, 835 bp, Homo sapiens
  misc_feature: GYAE6OF01C5I40.17.34.D01.1.454.CMB.1.raw
  modified_base (175)..(175): a, c, t, g, unknown or other
  misc_feature (175)..(175): n is a, c, g, or t
  modified_base (792)..(792): a, c, t, g, unknown or other
  misc_feature (792)..(792): n is a, c, g, or t
tcagcgtagactagcacgaccggtgctcgatttagatcgtctgtggttgggtttggggatcaacaaaacaaccagattccctcctactaaagaacgccccgtgggagcacagctcatcaccagtggactggacctggtacggttccttcgtttggtggtggcagcgagactacgngggtcgtacccgacgtccccgaggtccgtaggtttgggtacgactaaggttccgggttgggggcgttagggaggggtacggaaacggacccggtcccgggttcggggttcccgttacgggggtaggtacccggggttcctaccggtaggtaaccggtaacggggttcccgttttacgggacggggaaccggtacccttacccctttacggaacggtaccgttaacgttaaccggttttaggttttaaccggaaggggttttcggggccggtaccggggtacccgggtccttagggaccgggaaaccgtacgggtccgttagggaggttcgggaaggtggggaaacgtccgttaccgtcccgttagtcggtaaccgaacaacccaaacgtaccgaaccgacgaaacgttaaccggaacgtaccggaggacctacgacctaccgaaaccgtaacggtaccgagtaaacctaacgtaacgaacacgtaatacgtcgagtagaacgtacgaacgtctacgtgtactacgacgtacgaacggtacgtccggtcttacgttacgtgtacgtacggagtacgtaattacctagtaactacgtcctcgttaccttcgtttacccncttaccgtgtccgtacgacgtacgacgtacccggtcgtacccg

SEQ ID NO: 104261 - DNA, 895 bp, Homo sapiens
  misc_feature: GYAE6OF01DX9AS.17.34.D01.1.454.CMB.1.raw
tcagcgtagactagcacgaccggtgctcgatttagatcgtctgtgttgggtttggggatcaacaaaacaaccagtatttcctcctactaaaagaacgccccgtgggagcacagctcatccaccagtggacgtggacctgggtacggtttccttcgttttggtggtggcaggcacgactacgaggtcgtccgacggtcccaggtccttaggttggtcgactaagttcgtggggtctaggtacggtagaacgccggtccgtcgggtccgtacgggtggtcggttccttcgtcgacgtacggttcttcggaggaccgtcctaccgttaggacgtaccgtaacgttagtttacggtttacgtaggtttcgggcggaccggtaccggttacgttcggacggtaccggtaacggttccgttagggaaggtcggtaagggtaagggtacgttacgttcccgttaccgttacgttacggtacgtaaaccaaccgtaaaacctaaccgtaaccgactaaacggtaacggttaaccggtacggaacggactaacgaccgtaccaaccggtaaaccgtaacgaaccgtaaactaaaaccgtaacgtaacctaacgtttaacgtacgttaacgtacggtaacgtactaaaccggacgtaccgttacgtacgtaaccgtcgtacggaacgggtaacggtaccggttaccggtttaccttacggttacgttcgggtacgcggttaacggtaacggtttaaccttaaccttaaacggttaacctttaccgaccgtttacccggtttaaccttttaccccgtttaaccctttaccgttacccgttaacgtttacccgggttccgggaaccttaaccccggtacggttaaccccccgggtccgttacccccg

SEQ ID NO: 104262 - DNA, 943 bp, Homo sapiens
  misc_feature: GYAE6OF01CE6ZO.17.34.D01.1.454.CMB.1.raw
  modified_base (164)..(164): a, c, t, g, unknown or other
  misc_feature (164)..(164): n is a, c, g, or t
tcagcgtagactagcacgaccggtgctcgatttagatcgtctgtgttgggttgggaacaaaacaaccagattcctcctactaaagaacgccccgtgggagcacagctcatccaccagtggactggaccgtggacgtttcctgtttggtggtgcagcagctacgnggtgtccacgtcccaggtcctaggttggtgactaagtcggtgggctaggaggtagaacgcgtcgtcgggtccgtgggtggacggtctccgtaggacgtacggtcgttcggagggtaccggtacctaccgttcgaacggaccgttaacgttaacgttagttttaacgtaagggtttcgggacggtaccggtaccgggtcccgttaggtaccggtaacggtacggtaaccggtttgaaggttgggaaggttaggaaacggtccgttccgtaccttacgtccggtaacgaacccgtaaacaaccccgtaaaacgaccgacgaacgtaaacgtaacggtaccggaacggactaaccgaaccgtaaccacaaaacggtaacccgaaggttaaaaactaaacctaaaccggtaaactaacgtaacgttaacgtacgtacggtaacgtacgtaaaccgacgttaaacgcccgtttaacgacccttaaaggtccggaaagggttacccggacccggtaccccgttttacgtttacccgttacgttaccggttacgggtaacggtaaccgggtaaagtttaaacgttaaacctttaacttaaacccggttaactttacccttaaacccggttttacccttttaacccccgtttaaaccgttttccccccgttttaaccggtttaaacccggtttacccgtttaaccccggggttcccgggtaaaacccggtttacccccggtaacccccgggtaacccccggtttcccgtaacccccggtttcccccg

SEQ ID NO: 104263 - DNA, 800 bp, Homo sapiens
  misc_feature: GYAE6OF01CPJEO.17.34.D01.1.454.CMB.1.raw
  modified_base (268)..(268): a, c, t, g, unknown or other
  misc_feature (268)..(268): n is a, c, g, or t
  modified_base (344)..(344): a, c, t, g, unknown or other
  misc_feature (344)..(344): n is a, c, g, or t
tcagcgtagactagcacgaccggtgctcgatttagatcgtctgtgttgggtttggggacaaaacaaccagattcctcctctaaagaagccccgtgggagcacagctcatcaccatggactggacctggaggttcctctttgtggtggcagcagctacgagtgtccagtcccaggtccagttggtcgacaatcgtggggctggagggtgaacggctccgtgggtcctgggtgagggtcctcgtgcgagtcttcgtgggacgcctacctnacgcgtacttagttacgtttcaaggtttgggcgacggtaccggtctcgtaggaccgtacggtccgttggacgtggngttaggggaacgacgtttccgtacctgtacgttacgaccaactaaccaacctcgacacgtaacggtaccttacggaacgggtacaacggtcctacccgaacccgtacgtaaaacccggacggtaaaactaaaacccggttaaacgtaacgtaaccttacgtttaacgtaccggtaggtacgtacgtaacgtaacgtaaccgtcgtacggtctacgtcggtaacggaccggtaccgttacggttccctttacgtttaccgttccgttagggaccggtttaaggtacggttaaacgtttaaccttacttaaaccggttaccttaccgttacccgttaaccttttaccccgttttacctaccccggttttaccggttcccggttaacccgttccggtacccgggttaacccgttccggttaacccccgggttaacccccgtcgttaaccccccgtcccg

SEQ ID NO: 104264 - DNA, 1086 bp, Homo sapiens
  misc_feature: GYAE6OF01AO6YP.17.34.D01.1.454.CMB.1.raw
tcagcgtagactagcacgaccggtgctcgatttagatcgtctgtgttgggtttggggtacgatttgatgttacctgatgcttagaggtctttttcctggaagcagggctatttgttgcttcagcaccgtagtgcctcgtcatcacgcctcacgtccttgtatttttccggtatttcgcctaggaaaaccacgccctaacccgtaccgttaaacccgggacaacccggtccggcccggaccaaacatacgtcccttccttcccccgttccccccttagacctaacgtaaccacctaaggtaaccaagggtaaacttactttaaacccgttcgttttaccccacgtaccggaaccttacccggtcccgttttcccggcccgttacggtcccggtttaacgggggtcccgtaaccttacccgaacccccgttacccggtaccccccggttaaagttttaaacccgggtttcgggaaacccgtaccggggttaaaccccgttttcggggtacccgtttacccggggcggtaacggtcccggggttcctttttacccgaccccgtttctttttacgtacccgttttaactttaacgttcggtacgaacggttcttaacgtttccggtacccttaacttttccgtaaccgtaactttacccccgtacgtaaccgtacctaccgttacccggtaccctacccgtaaccgaacggtacccccttaaacccgttaccccggtttacctaaaccggtacccggttaaacccgtttaaacccgaaccggttaaacccccttaccccccgttaaacccccccgttaaaccccaaaacccccgggttaaaccgtaaccgttaaacccggtaacggttaccccggttaccggtacccccggttaccggaccccggttacccgtaacgggttccgtttacccggggttaccgttaccgggtttacccggttttacccggggttttaaacccccggtttcccccgttttaacccgtttaaccccgtttcccccgtttaaccccgggcctttaaccgttccgttaaaccgttaccggttacccgggttccgttaaccccgggg

SEQ ID NO: 104265 - DNA, 670 bp, Homo sapiens
  misc_feature: GYAE6OF01BHQLJ.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctggggtcctcggtgacgggtctccgtgacgaaggtcttcgtgggacggctaccttcgacgcgacttaatagttttcaattgggtgcgaccggggtcctctggacaaggccttggacgtggagtaggggacggtagtccgtcctagtcgtggacacaccaaactacgcacagactccgagggcagacacacccaagtaaccgacggaacaaaacgttaacgaacaacgagttaactcgtaggcgacgtagaacacgtacctgtcagtctaggaacggtaccgacggtcctttacgttactttcgttacggtcgggtacgtaacgggtaacgtttaacttaccgtaaacttaaccgacttacggtacctttacccgttttacctacccgtttacccttacggtaccgtttcggtacggggtccaccggtacccggtaccccggtccgtcccgttaccccg

SEQ ID NO: 104266 - DNA, 711 bp, Homo sapiens
  misc_feature: GYAE6OF01DWL0I.17.34.D01.1.454.CMB.1.raw
  modified_base (291)..(291): a, c, t, g, unknown or other
  misc_feature (291)..(291): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatctggggctgaggtgaagacgccgtgggtcctcgggtgagggtctcctgcgaaggtcttctgggacgcctaccttcgagcgtactatagtttcaagttgggngccggaccgggcctcgtggacgtaaggtccgttgacggtggagtaggggaagtactccgtacctagtcgttcgaaccaccaaccgaaactacgcaacgtaacgtaacgttccgagggaccacgtacctacacccgtaacgtaacccggacggaaacctaaacgtaaccgaactaacgtaattaancgtagagtctaacgaacngtacctacgtacacgttacgtaggaccggtaacgtaccgggttcctttaccgttacgtttcgtacggttacggaacggttaaggtaacggttaaacttaacgttaactaaaccgttcttaacggttcccttttaccttttacccctcccgtttacccgttacgttaccgttaccggtaccgggtaccctaccggtaccccgggtaccccgttacccg

SEQ ID NO: 104267 - DNA, 810 bp, Homo sapiens
  misc_feature: GYAE6OF01CFNHW.17.34.D01.1.454.CMB.1.raw
  modified_base (185)..(185): a, c, t, g, unknown or other
  misc_feature (185)..(185): n is a, c, g, or t
tcagcgtagactagcacgaccggtgctcgatttagatcgtctgtgttgggtttggggatcacaaaacaaccagattcctcctctaaagaagcccctgggagcacagctcatcacatggactggacctggagttcctcttgtggtggcagcagctacaggtgtccagtcccaggtccagttggtgnaactctggggctggaaggtgaagacgcctgggtcctcggtgacgggtctccgtgacaggcttcgtggacgcaccgttacagcgtaactagttagttacaagttggtgacggacggctcgtaggacaaggtccgttaggacggtggaagtcgggaagtactaccggtccctagtcgttacgaccgaaccaaccgtaaacgtacgtacaaacgtaaggtaacgttaccgaacgggacaacggtaacctaaccaaccgtaacgtaaacccggaaccggtaaactaaaaacgttaaaccgaaaaccgtaaccgtaaagtttaaaccgtacggttaacgggtaaacgtacgttaaacggaaacccgtactacccggttaggttaaccaacgtttacccggagggtaaacgggtaacccgtaacggggttacccttttacgtaacccttttacggtcggtaacggtccggaaaaggtttacgggttaaaacttacggttaaacgttaacctaaccgttacgtttacccgtttaaccctttttaaccgtcccctttaaccccttaggtttaacccgttccggaaccggggttaccctaaacccgggttcccggtaaacccccggttaccccg

SEQ ID NO: 104268 - DNA, 789 bp, Homo sapiens
  misc_feature: GYAE6OF01A7O9W.17.34.D01.1.454.CMB.1.raw
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttggtggtggcagcagctacaggtgtccacgtcccaggtccagttggtgcatcgtgggctgagtgagacgccgtgggtcctcggtgaggtctcctgcgaacggtcttcgtgggacggacctaccttcacgcgtaacttaagttacggtttactaagttggggtcgaccgggaccgggtccctcgtaggaccgaacggtccggttagaggttagggacggttaggggaaggtaccttccggtaccccttagttcggttacgaaccctaacctaaccaaaccgtaccgaaccaacgaaggtaacgtacccgaagggtccaacgtaccctaccaaccgtaacgtaaccggaaaccggtaaactaaacgtaaccgaaacctaaacgttaagttaaccgtacggagacgtacgtaagaacgacgtccctagtacctacgtcgtaggacgtaccgtccgggttacctttccgttacgttcggtagtacggaacgttaacgggtaattaacgtttaaacaacttacctaacgtttcccgttaacctttttccccttttaaaccctcccccgttttaccgttaccgttaccccgttttcggtaacccggggtaccctttaaacgggtcccccgggtttaacccccggttacccccg

SEQ ID NO: 104269 - DNA, 758 bp, Homo sapiens
  misc_feature: GYAE6OF01BAU4C.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttggtggtggcagcagctacgaggtgtccacgtcccaggtccagttggtgcaatcgtgggctggaggtgaagccgccgtgggcctcggtgacgggtcctcctgacgtaacggtcttgtgggacggcctaccgttcaggtaccgtacttaattacgtttacgtaaggtttggggcgaccggaccggtacgtacggtacgggtaccgtaacgggtccgttaggaggtacggaggtaggggaacgtcgttccgttacccgttagttcggttacgaaccgtaaccgtaacccgtaaacgtaccgactaacgaacggttaaccgtccggaggtacctaaggtaccttaccaaccgtaaccggtaaccgtaacggtaaaactaaacgttaaaccgaacttaaccgtaaggttaactacggaggtaacgtctaacgaacgtcgtaccgttcgactacgtacgacggtacggaccgtcggttctaccgtttacgttacggtcgtacggaacggtaagtacgttaaacgtactaacgtactacggttcctacccttttacctttaaccgtccccttacgttcgttaccgttacggtcggtaaccgtcggtacccggtaccccgtcccg

SEQ ID NO: 104270 - DNA, 780 bp, Homo sapiens
  misc_feature: GYAE6OF01EJ6A6.17.34.D01.1.454.CMB.1.raw
tcagcgtagactagcacgaccggtgctcgatttagatcgtctgtgttgggtttggggatcacaaaacaaccagattcctcctctaaagaagcccctggggagcacagctcatcaccatggactggacctggaggttcctctttgtggtggcagcagctacaggtgtccagtcccaggtccagttggtgcatcgtggggctgaggtgaagacgcccgtgggtcctcggtgagggtctcctgctaggtcttcgtggacggcaccgttcagcgtacttagtagttcaagttcgggtagccggaccggggtcctcggtacgggaaccgtaacgggtcccgtttagggtagggtcggggtaacggttacgggggtaaaagggtatttaccccggttacccgtttaacgtttccgggttaacggaccaaacccggtaaaaccctaaacgtaccggaaccgtaaacggaacggttaaaccgggtttacccggaaacggggtaccaaggtacccgtaccaaacccgtaacgtaaacccggaccggtaaactaaaacttaaccgaacgtaaacgtaagttaacgttacgtaggaacgtacacggtaaccacgtccgttacgtctagttacgtgtaacggacgtaacggtccttacgttacttccgtgtaggtacgaaggtaacgttaaacttacttaactaccgtactacggttacccttttcttttaccctccctttaccctagttccgtacggttcggacccttagtaccccggtacccggttaccg

SEQ ID NO: 104271 - DNA, 872 bp, Homo sapiens
  misc_feature: GYAE6OF01AJ9RE.17.34.D01.1.454.CMB.1.raw
  modified_base (196)..(196): a, c, t, g, unknown or other
  misc_feature (196)..(196): n is a, c, g, or t
  modified_base (663)..(663): a, c, t, g, unknown or other
  misc_feature (663)..(663): n is a, c, g, or t
tcagcgtagactagcacgaccggtgctcgatttagatcgtctgtgttgggtttggggatcacaaaacaaccagattcctcctctaaagaagcccctgggagcacagctcatcaccgatcggactggacctgggaggttccttcgtttgtggtggcagcagctacgaggtgtccagtcccgaggtccaggttgggtnacgaagtcggttggggctaggtaagggtgaaacggccgtccggtcggggtccgttcgggtaggtacgggttcctccggtgacgacggttccttacggttcgggaccggtctacccgttcgacggtccgtaacttagttacgtttactaacggtttcgggtcggtcccgggtaccgggtccttcgggtaaccggaaccggtaaccggggtccgtttaagggagggttcgggtaacgggtacggggaaacggttcggttcccggttaccctttacggttaccgttaacgaacccaaccgtaaaacccgtaacccgtaacgaaccgtaacgtaacggtaaccggttaccggaacggcccaagtaacccctacgtaaaccccgaacgtaaacccggaaccggtaaacctaaaaacttaacccgaaactaacttaacgggtaactacgggtacgaacgtacgtacgtaaccnccggtacttacgtgtacgtcgtaacggtacgtaccggtacgttcgtttaccgtcgtttcgggtacggtagtacgttaaggttaacttcgtaaacgtctacccgttacgttcccggtttaccttttacccgtttacccgtcccctttaccggttcgttacccggttcggtaccggaccgttaccccggtaacccgttcccgggttaaccc

SEQ ID NO: 104272 - DNA, 643 bp, Homo sapiens
  misc_feature: GYAE6OF01ELW4N.17.34.D01.1.454.CMB.1.raw
  modified_base (253)..(253): a, c, t, g, unknown or other
  misc_feature (253)..(253): n is a, c, g, or t
  modified_base (581)..(581): a, c, t, g, unknown or other
  misc_feature (581)..(581): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgacaagtctggggctgacggtgaacgacggcctgggtcctcggtgagggtctccgtgcaggtcttcgnggaggcacttcgagtcgaacttattagtttcaagttggtgccgacggcctcgtggacacggtccttggagtggatgggaagctcgtacctagtcgtgacacaaccgaactacgacacagtaacgttcgaggcacgactacgaaccacgtaaccgaccgaactaaagttaacgaactacgtaattaacgtcgtaggtacgacgtaggaacctcgtaccgtgtactagtccgtagtaggaccggtaccggtcttacgttacgttcctggtacgtacggagttaacgttaattacacttaaacgtactacgttcccttaccgttttaaccnccccggttaccgttacgttccgttacgacgggtaccctacggttacccggtaccccgttacg

SEQ ID NO: 104273 - DNA, 896 bp, Homo sapiens
  misc_feature: GYAE6OF01AHT59.17.34.D01.1.454.CMB.1.raw
  modified_base (196)..(196): a, c, t, g, unknown or other
  misc_feature (196)..(196): n is a, c, g, or t
tcagcgtagactagcacgaccggtgctcgatttagatcgtctgtgttgggtttggggatcacaaaacaccagattcctcctctaaagaacgcccctgggagcacagctcatcaccatggactggacctggtacggttcctctttgtggtggcagcagctacgaggtcgtccagtcccaggtcctaggtttcggtanactaagttccgtgggggcttggaggttacgaacgaccggtccgttaggggtccttcgggtggtacgggttcctaccgttggacaggtcctttacgtcggggagtcctaccttcgacggtaccggtaacttactttacggttttacctaaggtttcgggtagccgggacggtaccttcggtagggaaccgtaacggttccgtttagggacggttacgggtaggtacgggggtaaacgtcgttcccggttaccgttaggtttaccggttacgaaaccgaacccttaaaccgtaaaccgtaccggaccttaaaccgaaagggtttaaccggttaccgggaacggggttaccaaacggtaaccttaccgaaaacccggtaaggtaaaccccgggtaacggtaaacgttaaaaccgtttaaaccggaacctaaacggttaaacggtttaacgttaccgggtaacggtaacggttacgtaacggaaaccgttacgggtaccttaacgggttacacgttacccgggtaaggtaacccgggtaccgggtacgtttacccgtttacctttaacgtcgttacgggtacgaacgggttaccggttaattaacgttaaccattaaccgtacgttctttaccggtttacccttacggtacccttacgttacgtacgtttccggacgttacccgtacgttccccggacgttccg

SEQ ID NO: 104274 - DNA, 725 bp, Homo sapiens
  misc_feature: GYAE6OF01EQ8VS.17.34.D01.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggagttcctctttgtggtggcagcagctacaggtgtccagtcccaggtccaggttggtgcaatcgtgggctgaggtgaagcgccgtgggtcctggtgagggtctcctgcgaaggcttcgnggagctacttcngcatagtagttcaagttgggncggtacggccttcgnggacaaggtccttagacggtggagtgggaagtcgtccgtccgtatgttcgaacacctaacgaactacgcaacgaagtacgtcccgaagcagactacacgaaacgtaccggacgaaacctaaaagttaacgaacgtaacgtaacgttaaacgttgtaacgggtaacgtccgtaagaaacgtacgaccgttacgtacgtaactaccgtggtaacgggtaccgtaaccgggtccctttaaccgttaccgttttacggcggttacggaggtaacgggttaagttaacgtaaccttaacgttaaccctacgttacggtttacccttttaccccgttttaacccgtacccgttttacccgttacgttacccgttacccggtcggggtaaccccttacgggaccccgggtttaacccccggtcctacccggtttaccccc

SEQ ID NO: 104275 - DNA, 999 bp, Homo sapiens
  misc_feature: GYAE6OF01EATZG.17.34.D01.1.454.CMB.1.raw
  modified_base (267)..(267): a, c, t, g, unknown or other
  misc_feature (267)..(267): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacgaggtgtccacgtcccaggtccgaggtttggtgactaagtcgtggggctggaggtgaacgacgccgtcgggtccgtggtggtagggttcctccgtgacgaaggtcttcgngggacggacctaccgttacgacgccgttaacttagttacgttttaccgtaaggtttcggggacgtaccgggtaccgggtcccgttacggtagggaaacccggtaacgggtccgtttagggaagggttacggggtaagggttaacgggggaaacggtcccgtttcccggtttacccgttaagtttaccgggttacaaaccgtaacccggtaaaaccctaaacgtacccgaaccgtaaacggtaaacgttaaaccgggttaccggaaagggtacctaaaccggtaccctaacccgaaaccgtaaacccggtaaacccggaacggtaaaaaccttaaaaagttaaaccccggaaacttaaacgttaaacgtttaaaccggcggtaacgggtaccgttaaccgtaaaccgaaacgtacccgttccgttaaccggttaccgtaaacgtttccgggtaaccgggaaaccgggtaaccccgggttttaccgggttaccctttttacgttaaacccggtttccggttaacggggtacccggttaagggttaaaccgggtttaaattaaaccctttaaacgttaactaacccgttaaccgttacccgtttttacccttttaacccccgttttaccgtaacccccgttttaccttacggggttaacccgtttccgggaacccggtttacccggacccgggtttaacccccgggtaaccccgttccgtaccccggttaccccg

SEQ ID NO: 104276 - DNA, 794 bp, Homo sapiens
  misc_feature: GYAE6OF01CMCNX.17.34.D01.1.454.CMB.1.raw
  modified_base (137)..(137): a, c, t, g, unknown or other
  misc_feature (137)..(137): n is a, c, g, or t
  modified_base (145)..(145): a, c, t, g, unknown or other
  misc_feature (145)..(145): n is a, c, g, or t
  modified_base (160)..(160): a, c, t, g, unknown or other
  misc_feature (160)..(160): n is a, c, g, or t
  modified_base (164)..(164): a, c, t, g, unknown or other
  misc_feature (164)..(164): n is a, c, g, or t
  modified_base (168)..(168): a, c, t, g, unknown or other
  misc_feature (168)..(168): n is a, c, g, or t
  modified_base (391)..(391): a, c, t, g, unknown or other
  misc_feature (391)..(391): n is a, c, g, or t
  modified_base (576)..(576): a, c, t, g, unknown or other
  misc_feature (576)..(576): n is a, c, g, or t
tcagcgtagactagcacgaccggtgctcgatttagatcgtctgtgttgggtttggggatcaacaaaacaaccagattccctcctctaaaagaacgcccctgggagcaacagctcatccaccatggactggacctggngttccttntttgtggtgcagcanctanggtntccagtccagtcctagttgtgctaatcgtgggctagaggtgaagaccgccgtgggtccgttcggtggacgggttcctcgtcgacgtaacgggtccttcggagggtacgccctaccttcgacgaccggttaacttacgttaaggttttaccgtaaggtttcggggtaccggtccggaaccgggtcccgttacggtccgggaaaccgtaaccgggtccgtttagnggtacggggtaagtaggggaacggtacgtccgttacccgttagtccggtttacgaaccaaccgtaaaccaaaccgttacgaccgtaaactaacggtaagttacccgagggtaacctacgaaccctaccaaaccgtaaacgtaacggaacctaaacgtaaactaaccgaaactaacgtacgttaancgtaggacgtacgtaagacctacgtaccgtgttaccgatcgtacgaacgtaccggtacgttaccgttacttaccgttacgtcgtacggtacggtaaggtattaaccttacgtaacgtaccttagtacccgttttcccgtttaaccttttcccgtacccctttaccgttccgttaccggttcgtaaccgtcgtaaccgtaccccggtaacccctcccgg

SEQ ID NO: 104277 - DNA, 790 bp, Homo sapiens
  misc_feature: GYAE6OF01B8TX0.17.34.D01.1.454.CMB.1.raw
  modified_base (243)..(243): a, c, t, g, unknown or other
  misc_feature (243)..(243): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatccgtggggctgaggtgagacgccgtggtcctcggtgaggtctctgcaggcttcgnggagcaccgttcagcgtactagttacgtttcgaagttgggtcgccggaccgggtccttcgtacggaacctaacgggtcctttgggaggttaggagttacggggaaaggtacgttcccggttaccgtaacgtttcgggtttacgaaacctaccgtaaaccgaaaacctaccggacgtaaccgaagtaaacggttaccgaacggggtacaacgtaccgtaccaaccgtacgtaaacccggaacgtaacgtaaaaacgtaacgaacaacgtacgttaaacgtcgtacggtaacgtacgtagaaaccgtcgtaccgttagaccttaacgtcctacgggtaacgtaccggtaaccggttctttaaccgttcgtttaacgacggtacgggttaccggtaacggtaacgtttaattaaccttaacgttaaacccgtacggttccttaacccgtttaccttttaaaccccgtccctttaaccgtttcgtacccgtttgtacccggggttacctacgggttacccgtaacccgggttcccgtttcccggtaccccg

SEQ ID NO: 104278 - DNA, 941 bp, Homo sapiens
  misc_feature: GYAE6OF01DUMMJ.17.34.D01.1.454.CMB.1.raw
  modified_base (156)..(156): a, c, t, g, unknown or other
  misc_feature (156)..(156): n is a, c, g, or t
  modified_base (183)..(183): a, c, t, g, unknown or other
  misc_feature (183)..(183): n is a, c, g, or t
  modified_base (261)..(261): a, c, t, g, unknown or other
  misc_feature (261)..(261): n is a, c, g, or t
tcagcgtagactagcacgaccggtgctcgatttagatcgtctgtgttgggtttggggacaaaacaaccagattcctcctctaaagaacgcccgtgggagcacagctcatcaccatggactggacctggagttcctcttgtggtggcagcagctacnggtgtccacgtcccaggtccagttggngctaatcgtggggcttggaggtgaaacgtcgccgtgggtacctcggtggtagggtctccgtgcgtaacggtcttacgnggaacggtcctaaccgtttcaggtaccgtaatttaggttaacgttttaccgtaaaggtttcggggaccggtaccggtaaccgggggtccctttaacggtacggggaaaccgtaacgggggttccccgttttaggggaaaacgggttcggggggtaaaaggtttacggggggaaaccggggttaactttccccggttacccgggttaactttaacccgggttttaaacccaaaaccggtaaaccctaaaaaccggttaccggactaaaccggtaacggttaaccggttacccgaaggggtaccaaacggtaccttaccgaaccgaacgttaaaccggacgggtaaaaccttaaaaaggtaaaacccgtaacgtaacgttaaacgttaaacgtccgttaaggggtactaaccgttaacgaaccgtaaggtaccgttacgtacgtaactacccggtagggtaacggtaacccggtcggttaccttaaccggttcttaccggttaggtaccgggtaagtaacgggttaacgtttaacttaacggttaaccgtaaacttaccgttacgttaccttttaaccccggttttcctaaaccccgttccggtttactaccggtttaccggtacgggtaccgttaacggtacccgtaaccccggttcgtaaaccccgttcttaaaccccgg

SEQ ID NO: 104279 - DNA, 838 bp, Homo sapiens
  misc_feature: GYAE6OF01BSET3.17.34.D01.1.454.CMB.1.raw
  modified_base (250)..(250): a, c, t, g, unknown or other
  misc_feature (250)..(250): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggacggttcctctttgtggtggcagcagctacaggtgtccagtcccaggtccagttggtgcaatcgtggggctggaggtgaagacgccgtgggtcctggtgagggtctctggcaggcttcgngggtagctaccttgacgtcgaacttagttagtttaccaagtttcgggcgtccggtaccgggtcctacgtaggaaccgtaaagggtcccgtttaggtaaggttcgggaaggttacgggggtaaacgggtacgttacccgttacccccggttaagttcccgggtttaacggaaccccttaaccgtaaacccgtaaaaaccggtttccgaccgtaaacccgtaacgggttaaaccggtttccggaaacgggggtacaacggggtacccctaccggtaaacccgtaaggttaaaccccggacggtaaacgtaaaacgtttaaaccggaaacctaacgtaagttaactacggtacggtaacgtacgtaacgaaacgtaggacccttacggttactacgttacgtaacggtaacggacgtacgggtaccgtttacgttacgttacgtacggtacgaacgggtaacggtacgttaaacttaacgtaacgttaaaccgtaccgtacgtaccggtttacccttttaacgtaccccgttaccttacgtaaccgttcgttaacggggtaccctacggttccggtaacccccggtaaccg

SEQ ID NO: 104280 - DNA, 674 bp, Homo sapiens
  misc_feature: GYAE6OF01CLLOM.17.34.D01.1.454.CMB.1.raw
  modified_base (249)..(249): a, c, t, g, unknown or other
  misc_feature (249)..(249): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggaggttcctctttggtggtggcagcagctacaggtgtccagtcccaggtccagttggtgcaatcgtggggctgaggtgaagacgccgtgggtcctggtgagggtctccgtgcgaaggtcttcgnggacgcaccttcagcgactatagtttcaagttgggtgcggacgggcctcgtggacaaggccgttggaagtggagtgggaagtctcggtacctatcgttgaacaccaaccaaactcgacaacgagaacgtccgaaggcaagtaccacaacctaagtaaccgaacggtaaactaaaacttaaccgaacaacgtaaagttaactcgtacggaacgtactaacgaactaacgtctacggtaacacgtacgtaggaacggaaccgtacggtcctttacgttacttacggttgtaccgaggtaaggtaacgttaattactaactaactacgtacgttacctttacccttttaccacccgtttacccttcgttaccgttacggtaccgggtaccctacgtacccggttaaccccgtccgtacccgttacccg

SEQ ID NO: 104281 - DNA, 873 bp, Homo sapiens
  misc_feature: GYAE6OF01CDM7Y.17.34.D01.1.454.CMB.1.raw
tcagcgtagactagcacgaccggtgctcgatttagatcgtctgtggttgggtttgggatcacaaaacaaccagacttcctcctctaaagaacgcccctgggagcacagctcatcaccgatggactggacctgggaggttcctcgtttggtggtgcagcagctacgaggtcgtccacgtcccgaggtccaggttggtgctagtcggtggggctggaggtgaacgccgccgtcggtcctcgggtaggacggtctccgtgacgacggtcttcggtggaccggtcctaccgttacgacggtccgttaacgtttacgtttacggtttaaccgtaagggtttcgggtacgggtcccggggtaaccggggtcccttacggtaagggtaaccgtaacgggttccttagggaggtacgggtaaggtacggggaaggttaccttccggttacccttaaggttccgttaaggaaccctaacccgtaaaacctaaaccgttacgaaccgaaacgtaaccgtaacggttccgaacgggccaacggtacctacgaaaccgtaacgtaaccgaacgaaactaaacgtaacgaactaacgtaactaacgtacgtacggtaacgtacgtaacgtaaaccgcgttaccgtacgtacgtacgttaaccggtacggaacggttaacccggtcgggtttacctttacggtttacccgttgggtacggttacgggtaacggttaggtaaagtttaacccttaagttaaccgtaaacgttccgttaccgttttacccgtttaacccttttaaccccgtccccgtttacgtttaccgttaccccgttacggtaccggttaacccgttaccggttacccgggtacccccgtaccccgg

SEQ ID NO: 104282 - DNA, 841 bp, Homo sapiens
  misc_feature: GYAE6OF01CWIKO.17.34.D01.1.454.CMB.1.raw
  modified_base (195)..(195): a, c, t, g, unknown or other
  misc_feature (195)..(195): n is a, c, g, or t
  modified_base (259)..(259): a, c, t, g, unknown or other
  misc_feature (259)..(259): n is a, c, g, or t
tcagcgtagactagcacgaccggtgctcgatttagatcgtctgtgttgggtttgggatcaacaaaacaaccagattcctcctctaaagaacgccctgggagcacagctcatcaccatggactggacctggtacggttccttctttggtggtggcagcagcttacgaggtcgtccacgtccaggtccaggtttggngacaagtcggtgggctaggaggtacgagaccgccgtcgggttccgcggtaggacggtcttccgngacgtaacggtcttgagggagtcctaccttgacggactaacgttagtagtttacgtaaggtttcgggacgccggtaccggtctccggtaggaacgttaacggtcctttaggaggtggtaaggtacggtaaacggttcgttaccgttaccccgttagttaccggtacggaaccctaaacccggtaacctaaacccgtacggtaacgaacgtaaacgggtaaccggttaccggaacgggtacaaccgttaaaccgtacccggaaaaccgttaaccggaaaaccggtaccgtaaaaacgttaaacgttaaacccgaaactaaccgttaaagtaaccgtaggtacgtaacggtactaacgaaccgtaacgtccgtacgttaccgagttacggtacgggaacgtaccggtacggttctttactttacgttacggttcggaacggtacgttagtaacttaacggttaactacgtaaccgttaccgtacgtttacccgtttaacccttttacccggtacctttacccgttacgttaccgtttacccgggacggttacccgaaccgggtcccgttaacccccgggttacc

SEQ ID NO: 104283 - DNA, 618 bp, Homo sapiens
  misc_feature: GYAE6OF01BOGNG.17.34.D01.1.454.CMB.1.raw
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (422)..(422): a, c, t, g, unknown or other
  misc_feature (422)..(422): n is a, c, g, or t
tcagcgtagactagcacgaccggtgctcgatttagatcgtctgtgttgggtttgggatcacaaaacaaccagattcctcctctaaagaagccccctgggagcacagctcatcaccatggactggacctggagttcctctttgtggtggcagcagctacaggtgtccagtcccaggtccagttggtgcaatctggggctgaggtgaagacgccgtgggtcctcggtgacgggtctccgtgcaaggcttctgggacgcaccttnagcgactattagttcagttgggncgacgggtcctgtggacaaggtccttggagtggagtgggaagtctcgtcctatcgtgacacaaccaactcgcaanagtaacgtccagggcagactacacataaccgngaacaaattacgaacactagtatctagganctagaacacgctagactatcgtagacggacgtacggtcttactacgttcgtagtcgtacgtaggtacgttaatttaacctaataaccgtactttcggaccctttttacccgttttaccctacccctttcccttaaggttacccgtttacggtcggggtaaccctaacggttaccccggggtaaccccgttaccccg

SEQ ID NO: 104284 - DNA, 744 bp, Homo sapiens
  misc_feature: GYAE6OF01E032W.17.34.D01.1.454.CMB.1.raw
  modified_base (140)..(140): a, c, t, g, unknown or other
  misc_feature (140)..(140): n is a, c, g, or t
  modified_base (159)..(159): a, c, t, g, unknown or other
  misc_feature (159)..(159): n is a, c, g, or t
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (594)..(594): a, c, t, g, unknown or other
  misc_feature (594)..(594): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctcttgnggtgcagcagctacaggtntccagtcccaggtccagttggnacgaactcgngggctgaggtnaagacgtccgtgggtcctaggtagacggttccnccgtgactaggtcttcgnggagcctacctcgacgcgtatagttagttctaaggttcgggtcgccggacggtcctagtaccggacgaaggtccgttggaggttcgaggtaggggtaacgcgtttaccgtcccgttactcggtacgaaccgtaacccgtaacccgtaaatacccggtaccaacgtaacgtaccggttaccgaccggggactaacggtacctaccgaaacccgtacggtaaaaccccggtaagaaaccgtaaaacgtaaaccgaactaaccggttaacttactacggtacgacgtacaacgaactaccgcgtaacgtcactagagaccgacgtacggtcttacgtcttacgnggtacgtaagtacgaacttaatacctaataccgtaaccgtccgttaacccgttttaccttaccctaccccggttacttcccggtaacgtttcggtacccccggtacgtttaaaccggaccccggttaccccggtacctccccggttcccg

SEQ ID NO: 104285 - DNA, 573 bp, Homo sapiens
  misc_feature: GYAE6OF01AXU8Y.17.34.D01.1.454.CMB.1.raw
  modified_base (292)..(292): a, c, t, g, unknown or other
  misc_feature (292)..(292): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacaggtgtccagtcccaggtccagttggtgcaatcgtggggctggaggtgaacgacgtccgtgggtcctggtgacgggtctcgtgcaggtcttcgtggcgctaccgtcagcgtatagttgttcaagttcgggtncgacggtcctcgtggacaggccttggagtgagtgggaagtctcgtctagtcgtnacacacactcnanagtagtcgnggacagtctcgacacaccgcgaactaactaacaacagtaatactcgtaggactacgacgaacncgtacgtntacctnacgtggacgaccgtcgtacttacgtagttctggtacgagtacggtattacgtactataacgacttacgtcctttacttaccgtccttactcgtacgttccgcggtacctccggtcggtaaccccgtcg

SEQ ID NO: 104286 - DNA, 800 bp, Homo sapiens
  misc_feature: GYAE6OF01CW0N0.17.34.D01.1.454.CMB.1.raw
  modified_base (353)..(353): a, c, t, g, unknown or other
  misc_feature (353)..(353): n is a, c, g, or t
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
  modified_base (516)..(516): a, c, t, g, unknown or other
  misc_feature (516)..(516): n is a, c, g, or t
tcagcgtagactagcacgaccggtgctcgatttagatcgtctgtgttgggtttgggacaaaacaaccagattccctcctactaaagaacgccccgtgggagcacagctcatccaccatggactggaccgtggacggttcctcgtttggtggtggcagcagtctacgaggtcgtccacgtccccgaggtcctaggttgggtgactaagtcggtgggggctgggaggtagaacggccggtccgtcggggttccgtacggggtggtacgggttcctccgtggaccgtaggtccttcgtggacggccgtaacccttgaacggtcgtaacgttagttacgtttacgaaggtttggggnggtcccggtaccgggtccttggtacggacgaacggtccgttaggaggtaggagtaggaagtctaccgtctagtcgtagactacaccaacncgactaacgagtacgtcgagcacgtacncaacctacgaaccgagaaactaaacgtaacgaacagtaacgttanaccgtaggacacggtaagaaccgcgtactacggttaccacgttacgacggaacggtaccggaccggtttccttaaccggttcttacgggtcgtacgggtaacgacgggtttaaacttaaccgttactaaaccggtactaccgtttaccggttacccctttttaacccgttttaccctaaccccgtttccccgtttaaggttaccccccgggtttggtaaccccggggtacccgtaacccggtttaccccgggttaaacccccggtccgtttccccgtaaccccg

SEQ ID NO: 104287 - DNA, 758 bp, Homo sapiens
  misc_feature: GYAE6OF01BHPC6.17.34.D01.1.454.CMB.1.raw
  modified_base (666)..(666): a, c, t, g, unknown or other
  misc_feature (666)..(666): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccgaggtcctagttggtgacaatcgtggggtctgaggtagaacgaccgtccgtgggtccgtcgggtggacgggtcctccgtgtaccgaaggtcttcgtgggacggtcctaccgttacgaggtacgaaccttaagtttacgtttaccgtaaaggtttcggggtacggccggtaaccggggtccccttacggtaccggggaacgtaaacgggtccgtttagggaacgggttggaacgggttagggggaaaggtacgttcccggttacccttagttccggttacgaacctaaaccgtaacccaaaccgtacgaccctaacgtaaaggtaacctcggaacggtaccaacgtaccctacccgaacctaaacgtaaacccggacggtaaactaaacgttaaaccgaaacctaacgtaagttaaccgttacgtaaggaacgtacgtaagaccgtacgtactagctaagtcgtagacgtacgcggttctagtactcgtagtagngtagtaatacttagactactcttactacgtttcctttacctccttccgttcgtattccggtaggtaccctcggtaaccccgtaccgtacccg

SEQ ID NO: 104288 - DNA, 884 bp, Homo sapiens
  misc_feature: GYAE6OF01BEF31.17.34.D01.1.454.CMB.1.raw
  modified_base (155)..(155): a, c, t, g, unknown or other
  misc_feature (155)..(155): n is a, c, g, or t
  modified_base (160)..(160): a, c, t, g, unknown or other
  misc_feature (160)..(160): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctcttgtggtggcagcagctanaggtntccagtcccaggtccagttggtgcaatcgtgggctggaggtgaacgcgccgtgggtcctcgggtgacgggtccttcgtgactaaggcttcgtgggacggtcctaccttacgacggtaccgtaattacgttacgtttacgtaacgttggggttacggccggtaaccggggtccttacggttacggtaaccgtaacggtccggtttaggaggttacgggtagtacggggtaacggtacgtacccggtcccttagtccgttacgaaccgacctaacccgtaaaacgttccgaacctaacgtaacggtaacggtttaccggacgggtacctaacggtacccgtaccgtaaacccgaaccgttaaaccggaccggtaaaactaaaaccgttaaaccggaacctaaccgttaaggttaaacgttaccgtaagggtacgtacgttaacggaaaccgtacgtaccttacgtacgtaacgttaccggtacggtaacgggtacggttaacccggggttacctttacgttacccgttacggttacgggttccggtaaccggttaacggttaacgtttaacgttaccgttaacgtaacccggttacttccgtttaacccgttttacgttttaccccttacccggttacctttcccggttacgttaaccccggttccgggtaaacccttaccggggttaccccgtaaacccccggtttgtacccccgtttaacccgg

SEQ ID NO: 104289 - DNA, 859 bp, Homo sapiens
  misc_feature: GYAE6OF01DOA0Y.17.34.D01.1.454.CMB.1.raw
  modified_base (139)..(139): a, c, t, g, unknown or other
  misc_feature (139)..(139): n is a, c, g, or t
  modified_base (191)..(191): a, c, t, g, unknown or other
  misc_feature (191)..(191): n is a, c, g, or t
tcagcgtagactagcacgaccggtgctcgatttagatcgtctgtgttgggttggggaacaaaaacaaccagattccctcctactaaaagaacgcccctgggagcacagctcatcacatggactggacctggaggttctntttgtggtggcagcagctacaggtcgtccacgtcccagggtccaggtttggngcaagtcgtggggctggaggtgaagcgccgtggtcctgggtagacgggtcctccgtgacgaaggccttcgtcggaggcctaccttcgagtcgaacttattaagtttacaaggttcgggcggtaccggacgggtcctcgtacggaacgaacggtccgttggaaggttacgggaggtaggggaaacggtactccggttaccgtagttaccggttacgaaaccgaaccaaaccaaaaccgtacgtaaccaacggtaaacgtaaccggttaccgaacggggtacaaccggtacctaccaacccgaaacgtaaacccggaccggtaaaacctaaaaaccgttaaaaccgaaaccgtaacgtaacggttaactacggtagggaactaccgtaacgaacccgtaacgtaccccgtagtaccgtaactacgtacgggaaaccggtaccggttaccgggttaccctttaacgttacccttgttacgtaacgggtacgggtaacgttaaagttaaacttaactaaacgttaaaccctaacgttcgttaaccccttttaacccgttttaaccctaccccgtttaccgtttaacggtacccgtttcggggtaaacccgggttaccgtaaacccgggttacccggggtaaacccccgggttacccgtacccggtttacccg

SEQ ID NO: 104290 - DNA, 903 bp, Homo sapiens
  misc_feature: GYAE6OF01BQ3EM.17.34.D01.1.454.CMB.1.raw
  modified_base (189)..(189): a, c, t, g, unknown or other
  misc_feature (189)..(189): n is a, c, g, or t
tcagcgtagactagcacgaccggtgctcgatttagatcgtctgtgttgggtttgggggatcacaaaacaaccagattcctcctctaaagaagcccctgggagcacagctcatcaccatggactggacctggaggttcctctttgtggtggcagcagctacaggtgtccacgtcccaggtccaggttggngacaatcgtggggctgaggtgaagacgccgtgggtcctggtgagggtctcctggcaaggtcttcgtgggacgctaccttcgagcgtacttagttacgtttacgaagtttcggggtgtcggaccgggtccttacggtacggaacgtaacggtccgtttaggacggttggggaggttacgggggaaaggtacgttaccgggtacccgttagttccggttacggaacctaaacccgaaccgtaaaacgttccgacaacgaaaggtaaccgttaccgaaggggtaccaacgtaccgtacctaacccgtaacggtaacccggaacgggtaaacttaaaaacgttaaacccggaaacctaaacgttaaacggttttaaactaccgggttaaggtaaaccggtacctaaaggtaacccgtagggtcccttacggtactaacttcggtaacgggaacgggaaccggttaccgggttacccttaccgtttaaccgttcggttaccgggttagggtaaccggggttaaggggtttaaaccttaaacgttttaaaccgttaaaccgtttaaacccgtacgtttacccgtttaccgttttttaaacccccttttaaccccggtacccccttttcccggtttaacggttaaccccggttttacgggtaacccgggggttaccctaccgggggttaacccccgggttaaaccccggtttaaccccggg

SEQ ID NO: 104291 - DNA, 814 bp, Homo sapiens
  misc_feature: GYAE6OF01ALEN5.17.34.D01.1.454.CMB.1.raw
  modified_base (253)..(253): a, c, t, g, unknown or other
  misc_feature (253)..(253): n is a, c, g, or t
  modified_base (575)..(575): a, c, t, g, unknown or other
  misc_feature (575)..(575): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctaacaggtcgtccagtcccaggtccagttgggtcgctaagtcgtggggctggaggtgaagacgcgtgggtcctcggtgagggtctcctgcgaggtcttgngggacgtccacctttcgaagtccgtactagttagtttcgtaacgtttgggtcggtccggacggggtccttacggtacgggtaaccgaacggtccgtttaggacggttaggacggttggggaaacggttagttcccggtacccttaggttaccggtttacgaacctaccgtaaaccctaaaaccgtacgaccgaactaaaggtaacgtttacccggaggacccgtaaggacctaccgtaacctaaccggtaacccggaaccggtaaactaaaacgttaaccggaactaacgtaagttaacgtacgtaggactgtaaccgtaancgtacctgacctagtacgtaggaccgacgtccggtactttacgtaccgttcgtaggtcgtacggtaacggtaatttaacggttacctaacggtaacctacggttacctttaacccgttttccctttttaacctacccccgtttacccggtttcgtttacccgttcgggtttcccggggaacctttacccgggtaaccccgggttaacccccgtttcccggtaacccccgttttccccgg

SEQ ID NO: 104292 - DNA, 727 bp, Homo sapiens
  misc_feature: GYAE6OF01CI63W.17.34.D01.1.454.CMB.1.raw
  modified_base (493)..(493): a, c, t, g, unknown or other
  misc_feature (493)..(493): n is a, c, g, or t
tcagcgtagactagcacgaccggtgctcgatttagatcgtctgtggttgggtttggggacaaaacaaccagattccctcctctaaagaagcccctgggagcacagctcatcaccatggactggacctggaggttcctcttgtggtggcagcagctacaggtgtccagtcccaggtccagttgtgcaatcgtgggctgaggtgaagcgcctgggtcctcggtgagggtctcctgacaaggtcttcgtggacggcaccttcgagcgtacgttagttagtttcaagtttcggggtagaccgggacgggtcccgtcgtacggacgtaacgggtccttaggacggttgggagtggggaagtacgtcgtcctagtcgtagaccacgacaacgtacgcacgagtaacgtccgagggacacgtactacaaccagtaacccgacgaaactaaacttaaccgaacactaagttaacgtcgtagggaaccgactaacgaaccgngtaccgtagtacctagttacgtacggaacgaccggtaacgggttccttacgttccttggtacgtacgggtacgtaagggtaactttaacttacctaaacggtaactaccgtacgtttacccttttacccgtttaaaccctaccccgtttacccgtttacggtaacccgtttcgggtaacccggtacccgttaacgtaccccggggtaaccccttccggtaaccccgttaccccg

SEQ ID NO: 104293 - DNA, 741 bp, Homo sapiens
  misc_feature: GYAE6OF01DW2TZ.17.34.D01.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
tcagcgtagactagcacgaccggtgctcgatttagatcgtctgtgttgggttggggacaaaacaaccagattccctcctactaaagaacgccccctgggagcaccagctcatcaccatggactggacctggacggttcctctttggtggtggcagcaggcctagaggtcgtccacgtcccgaggtcctaggttgngacaagtcgnggggctggaggtgaagacgccgtcggtccgtgggtcggaggttcctccgtagacgtaaggtccttacggtagggacgtacctaccgttcaggcctaacgttagttacgtttacgtaaggttcgggaccggtccggtaccggtacctacggtaacggtacgtacggttcgttaggaggtgggaaggtacgggaacgtccgtccgttacctgttacgtacaaccaacctaaccaacgaccacgacgtaacgtacgtaccggacgacgacgtaccaccgaaccgaaccgtaaccgaacgtaaactaaaccgtaacaacgtaacgttaacgtacgtacggtagacgtacacgtaacgtacgtcgtacgtactacgacgtacggtaccgaccgtacgttaccttacgtccgttgtacgtacggtagtaacgtacttaactactaactacttacttaccgttacctttaccttaccctccgttacgtacgttaccgtcggtaccgtacccgtaccggtaccccggtaccctccgtcccgtcc

SEQ ID NO: 104294 - DNA, 854 bp, Homo sapiens
  misc_feature: GYAE6OF01EJWWB.17.34.D01.1.454.CMB.1.raw
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagtttggtcgcaagtcgtggggctggaggtgacggacgccgttggggtcctcggtggaggtcctcngancggtacttcgnggacgctaccttcgagacgtaactacgttcgtttactaacgtttggggtcgccggaaccgggtcccttcggtacgtaaccgggtaacggtcccggtttaggtagggttacgtaaggtaacggggtacggtacgttaccccggttacccttaacgttcggttaacccgtaaccgtaaacccgtaaacccgtaaaccgtaaccgaccgtaacgtaacggtaacgtaccggacggacgacgtacctaccgtaaccgtaaccgtaaccggaaccgtaaacctaaacgtaaaccgtaaccgtaacgtaacgttaacgtacgtacggtacgtacgtaaccgacgtaccgtacgtacgtaccgtacgtacgtacggtaaccggtaaccggtaccggttaccgttaccgtttacgttacgttacggttacgtaacggttaacggttaaacgttaacttaaccgttaaacgtaaaccgttaccgtttccgtttacccttttaccccgtttaccccgtttaccccgtttacccgtttccgttaccggtttacccggttacccgggttacccggttaacccggttaaccccgggttaacccccgg

SEQ ID NO: 104295 - DNA, 904 bp, Homo sapiens
  misc_feature: GYAE6OF01C242T.17.34.D01.1.454.CMB.1.raw
  modified_base (265)..(265): a, c, t, g, unknown or other
  misc_feature (265)..(265): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggaggttcctcttgtggtggcagcagctacaggtcgtccagtcccaggtccaggttggtgcaagtcgtggggctggaggtgaacgcgccgtgggtcctggtgacggtctcgtgacgaggtcttcgtggacgcctaccgttnagcaagttattacgtttacaaggttggtacgccggacggtcctcgtaggacgtacggtccttaggaggtcgggtaggtaggggaaaggtccgttacccgtaccgttagttccggttacgaacccaaccgtaaccctaaaccgtaccgaaccaacgtaaacggttaaccgttaccggaacggacaaccgtaccgtaaccgtaacccgtaacggtaaacccgaaccggtaaaactaaaaccggttaaacccgaacgtaacgttaacggttaacgttacggtacggtaaacgtaccggtaacgaaccgtaacggtccgtttacgacgttaacgtacggtacggaaccgggtaaccggtaccggtttccgtttaacccgtttacgtttacggtacgggttaccggtaacgggttaaacgggttaaactttaaacgttaaccgtaaacgtttaaaccctacggtttacccgttttaaccctttttaacccccgtttttaaccccgttaacccccttttaccccgggtttaccgtttaaccccgggttttacccgggttaaccgggttaccccgggttaaaccccggggtttaacccccgggttaaaccccccggttccccggttaaccccggttttacccccgg

SEQ ID NO: 104296 - DNA, 911 bp, Homo sapiens
  misc_feature: GYAE6OF01AVMVX.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacgaggtcgtccgacgtcccaggtccagttggtcgcaagtcgtggggctggaggtgaagacgccgtcgggtcctcggtggacggtctacctgcaggtccttgtggaggacctaccgttcgacgtcgacttagttagttcctaagtttggggacgccggtaccggggtccttacggtacgggaaccgtaacgggtcccggttagggtaggttacgggacggtaagggggtaacggtacgttaccccggttacccgtaagtttccgggtaacggaacctaacccgaaacccgtaaaccgtaaccgaccgaacggtacggtaacggttccggaacgggtaccgtacggaacccgtacaacccgttaaacgtaaccccgggaacgtaaaccgtaaaacgttaaccgaaaccgtaaccgttaaggttaacgtacggttacgggaaccgttacgaaaccggtaaaccgacgttaccccgtaggttacctaacgtttacgcgggtaacggacccggtttaacggggttaccttttaccgggtaaccctttgggtaccgggttaaccggtacgggtaaaggttaaccgttaactttaaacccggttaactaaccgttaacggtttccccgtttaacccgttttacccctttttaaccccgcccccgttttaaccggttacccggtttaccgttaaccccgggggcccggttttaaccccgggaaccggttttacccccccgggaacccggttaaccccccg

SEQ ID NO: 104297 - DNA, 827 bp, Homo sapiens
  misc_feature: GYAE6OF01A71ZA.17.34.D01.1.454.CMB.1.raw
  modified_base (190)..(190): a, c, t, g, unknown or other
  misc_feature (190)..(190): n is a, c, g, or t
tcagcgtagactagcacgaccggtgctcgatttagatcgtctgtgttgggtttggggatcacaaaacaaccagattcctcctctaaagaagcccctggggagcacagctcatcaccatggactggacctggaggttcctctttggtggtggcagcagctacaggtcgtccagtcccaggtccagttggtnctaatcgtggggctggaggtagaacggaccgtccggtcggggtcccgtcgggtggtagggtcctcctgacgaggtcttcgaggacgttacctgagcgtatagtttacgtttacaaggttgggtcgaccggaccgggtccttacggtaggaaccgtaacgggtcccgtttaggaacgggttagggaacggttagggggaaacgttccgtttccccggttaaccctttaacgttcggttacggaaccctaaaccccgaaaccgtaaaaccgtccggaaccctaacggtaacggtaacccgttacccggagggtaccaacggtaccctaaccgaacccctaaggtaaccccggacgaaaaccttaaaccgttaaacccgaactaaccggttaacgtttaaacgtccggttaaggggaaccgtaccgtaacggtaaaacccgtccgggtacccgttatacccggtacgttaacggtacgggaaccgggtaccgttaccgggtttccttaaccgtttcgttccggtggtacgggacgttaaggtaattaccgtaatacttaaacgtccttaccgtttacctttaccctttaccaccgttccttacgtcctacggtcggacctacggtacccgcctccggtcc

SEQ ID NO: 104298 - DNA, 665 bp, Homo sapiens
  misc_feature: GYAE6OF01AF56C.17.34.D01.1.454.CMB.1.raw
  modified_base (442)..(442): a, c, t, g, unknown or other
  misc_feature (442)..(442): n is a, c, g, or t
  modified_base (606)..(606): a, c, t, g, unknown or other
  misc_feature (606)..(606): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttgcagtaacacaagtacaggaatataactgtttccatcgactacgcctttcggcctcgccttagggtcgactcaccctgcccgattacgtggacaggaacccttggcttccggcgagtcggctttcgacccgtctttatcgttacttacgtgtcagctattcgctacttctgtactacctccaagcgtaatgcctctaacngccactacttccaacacggacttaacgacgaacccgtccctaccccgtaccccaaacgtaaccgacctaacgtaacgtccgtcccgtacctccggacccgtacgtaaccggccgtttaccggtacgccgttaacgttccggggtttaaccgttcccccggtttntaaccttccccgtttccccgaccctaccgttcctacgtaccgttacgttacccgtacgg

SEQ ID NO: 104299 - DNA, 1028 bp, Homo sapiens
  misc_feature: GYAE6OF01EF3V6.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggacggttcctctttgtggtggcagcagctacaggtgtccagtcccaggtccaggttggtgacaagtcgtggggctggaggtagaagaccggccgtcggggtccgtcgggtaggacgggttcctccgtggacgtaaggtcttcgtagggacggtcctaaccgtttcgaacgtaccgtaactttaagttaacggttttaccgttaaaggtttcggggtacggtacccggggtaaccgggggtcccgttaccggttacgggaaacccgtaaccgggggttcccggtttagggaacgggggtttaggggtaacgggttaacgggggggtaaaccgggtaccggttttacccggttaccccggtttaaggtttaccggtttacccggaaaccctaacccgtaaaaccccgtaaaccggtaaccccggaccgtaaaccgtaaacgggtaaccggttacccggaacggggtaccgtaaccgtaacccgtaaccgaaacccggtaaaccgttaaaccccgggtaacggtaaaacccttaaaaacgttaaacccggaaaccgtaaacgtaacgtttaaaccgtacggtaacggtaaccgttaccgtaaacggtaacgtacggttacccgttagtaaccgtacgttccggtaacgggtaaccgggtacccggtaccgggttccttttaaccgttaccgtttaccggtcgggttaccgggtaacgggttaacggttaaaacgtttaaccgtttaaaccttaaccggttaaaaccttccgtttcccgttaaccctttttcccgttttaacccttacccgtttacccccggtttacgttaccggttccggttacccgggtaccgtacccgggtttaaccccggacccccggtttacccgtccccggtttaccccg

SEQ ID NO: 104300 - DNA, 792 bp, Homo sapiens
  misc_feature: GYAE6OF01A91J2.17.34.D01.1.454.CMB.1.raw
  modified_base (101)..(101): a, c, t, g, unknown or other
  misc_feature (101)..(101): n is a, c, g, or t
  modified_base (503)..(503): a, c, t, g, unknown or other
  misc_feature (503)..(503): n is a, c, g, or t
tcagcgtagactagcacgaccggtgctcgatttagatcgtctgtggttgggttgggatcacaaaacaaccagattcctcctctaaaagaagcccctgggancacagctcatcaccatggactggacctggacggttcctcttggtggtggcagcagctacaggtgtcagtcccaggtccagttggtgcaagtcgtgggctgagtgaacgcgccgtgggtcctcggtgacgggtctcctgacgaacggtcttcgagggtacgcctaccgtttacgacggccgtaaccgttaattacggtttaccgtaaaggtttcggggtccggaccgggtaccgggtcccgttgtacggaaccgaagggtccgttaggtaggtgggtagtaggggaacgtcgttacccggtacctacgtttacggtacgaacctaacccgaaaccaaacgttaccgactaacgaggtacgtccgagggcaacgtaccgaccaaccgtaaacgtaacccggganaaacctaaacgttaaaccgaacgtaaccgttaaagttaactacggtacggtaaccacgttaacgaacgaccgtctagactaacggtctacggacgtaacgtcggtttacctcgtttaccgtcgttagggttaccgtacggtaacggttacttaaacgttaacgtaacgttaccgttaacgttaccgttacccttaacccgttttacctccccgtttaacccgtttcgtaaccggtttacccggggtacgtaccccgttaacggttcccccgggtaacccgttaaccccg

SEQ ID NO: 104301 - DNA, 864 bp, Homo sapiens
  misc_feature: GYAE6OF01DKOCR.17.34.D01.1.454.CMB.1.raw
  modified_base (263)..(263): a, c, t, g, unknown or other
  misc_feature (263)..(263): n is a, c, g, or t
tcagcgtagactagcacgaccggtgctcgatttagatcgtctgtgttgggtttggggatcacaaaacaaccagattccctcctactaaaagaacgcccctggggagcacagctcatcaccatggactggacctggaggttcctctttgtggtggcagcagctacaggtgtccacgtcccaggtccagttggtgcaatcgtgggctggaggtgaagcgccgtggtcctggtgaggtctctgcaggtcttcgtggacgctacctnacgcgacttatagtttacaagttgggtagcggacggctcgtggacgaacggtccttaggacgtggagtaggggaacggtacgttccgtaccttaagttccggttacaccgaacctaaccaaacgtacgaccaacgtaacggtaacggttcccggaagggtccgaaacggtaccctacccgtaaaccgtaaccgttaaacccggaaccgaaacttaaaaccgttaaaaccggaaaccctaaacgttaaacgtttaaacgtacgggttacggtaacgtacgtaacggaaccgtacgtaccgttcttacgacgttaccgtagggaaccggtaccggtacccgggttctttacccggttaaccgtttcgttacgggtacggtaccggtaagggttaacgtttaaacgtttaaacccgttaaacgttaaaccgtttaaccgttacccgtttttaacccgttttaaccccctttttttaaaccccgttccccccgttttttaaccccgttacccggttttaacccgtttccccggggttaacccggggttaccccgtttaaccccgggttaaccccccgggggttaacccccgtttaaccccccggg

SEQ ID NO: 104302 - DNA, 878 bp, Homo sapiens
  misc_feature: GYAE6OF01B0PCN.17.34.D01.1.454.CMB.1.raw
  modified_base (187)..(187): a, c, t, g, unknown or other
  misc_feature (187)..(187): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccagttgtncatctgggctgaggtgaagacgcctgggtcctcgggtgagggttcctccgtgactaacgggtcttaccgtgggacggtacctaccgtttacgacggtccgtaacttaacgttacgttttacaaacggtttggggtacgccggtaaccggggtccttaccgtagggaaccgtaacgggtccgtttagggaacggttcgggaacggttaggggtaaacggttaacggttcccggttaaccccttaggtttaccggtttacggaaacccgtaacccgtaaacccgtaaaaccgttaaccgggtacctaaacggtaacgtaaaacccgggtttcccggaaacgggtacctaacggtacccgttaacccgaaacccgtaaccggttaaacccggacccgggtaaactaaaaccgttttaaccggaaaccttaacggtaacgtttaacgtaccgttacgggtaacgtacccgtaacggtaaccgtacgtccgttacgacctacgtccggtaggacggtaccgtacggttaccgtttacctacggttacgtacggtacggtacggtaaggtaagttaacctttaacgtaactaacccgtcgttaaccggtccttttaacccgtttaccgtaccccttcggttaccgtacgtttacccgggacggtacccttacggtaccccggtaaccccgttcccgg

SEQ ID NO: 104303 - DNA, 822 bp, Homo sapiens
  misc_feature: GYAE6OF01CK732.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacgaggtgtccagtcccaggtccaggttggtgcaagtcgtggggctggaggtgaagcgccgtgggtcctcgggtgagggtcctcgtgacgaacggtcttcgtagggacggctaccttcaggccgaattacttacgtttacgaaggtttggggacgtaccgggacggtccttcggtacggaacgtacgggtcctttagggaggtacgggtaggtacgggggacgtacttccggttcccttaggttcggttacgaacctaacctaaaccaaacgtacaccgtaactaacggtaacgttcccggaagggtacaacggtaacctacgaaaccctaacgtaacccggacgaaactaaaagtaacccggaaactacggtaacgttaactacggtacggtaactacgtaacgtaacgtaacgcccgttaagtacgtaaccgttacggtacggtaaccggtaaccggtacccgggttttaacttaccgtttaccgttacgggttcggttaacggtaacggttaacgggttaacgttaaactttaaccggtaacttaaaccgtcgttacgttttcccctttaacgttttcccctaacccgtttacccgttacgtttaccggttaccggtaccgggttcccgtaacggttacccccggtaccccggttaaccccgg

SEQ ID NO: 104304 - DNA, 1134 bp, Homo sapiens
  misc_feature: GYAE6OF01D2LMC.17.34.D01.1.454.CMB.1.raw
tcagcgtagactagcacgaccggtgctcgatttagatcgtctgtgttgggtttggggatcaacaaaacaaccagattccctcctactaaagaagccccgtgggagcacagctcatcaccatggactggacctggacggttcctctttgtggtggcagcagctacaggtgtccacgtcccaggtccagttggtgactaagtcgtggggctgaggtagaacgaccggccgttcgggtccgttcgggtacggtagggttccctccgttcggacgtaacgggttccttcgtagggaacggtccttacccgttacgaagtccgtaacttaagtttacgtttaccgaaaggtttcgggggtacgaccggggtacccggggtaccttaccggtacggggtaaacctaacggggttcccgtttaggggtaagggttacggggaaagggtttaacgggggaaacgggttacccggtttaccccggtttacccccggtttaagtttaccccgggtttaccggaaacccgtaaccccgtaaaaaccccggtaaaaccgttacccgaaccgtaaaacccggtaacgggttaaaccggtttccccggaaacggggtaaccctaaaccggttaaccccgttacccgaaaaccccgtttaaaaccgggtaaaaccccgggaaacgggttaaaaaacccctaaaaagttttaaaaaccccggaaaccgttaaaccggtttaaaaccgggtttaaacttaccggggtaagggtaccgttaaaccgttaacgggtaaaaccccgtacgtacccgtttaccggttacgtaaccggtttcccggtaagggaacccgggttaacccggttacccggggtttacctttttaacccgttaaccgttttccgggtcggttaaaccggtacggggttaaaccggtttaacgttttaaaccgttaaacccgttaaacgttaaacccgttaccggtttaacccgtttttaccccgtttttaacccccgtttttaaccccgtaacccccggtttttaccccgttttaacgggttacccccggtttaccgggttaaaccccgggttaccccgggtttaaacccccggtaacccccgggggttaaaccccccccggttaccccg

SEQ ID NO: 104305 - DNA, 811 bp, Homo sapiens
  misc_feature: GYAE6OF01AVW3K.17.34.D01.1.454.CMB.1.raw
  modified_base (135)..(135): a, c, t, g, unknown or other
  misc_feature (135)..(135): n is a, c, g, or t
  modified_base (139)..(139): a, c, t, g, unknown or other
  misc_feature (139)..(139): n is a, c, g, or t
  modified_base (264)..(264): a, c, t, g, unknown or other
  misc_feature (264)..(264): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggaggttcctnttgnggtggcagcagctacgaggtgtccagtccccgaggttccaggtttgggtgccaagtcgtggggcctggaggtcgaacggccgccgtggggtcctgggtggacggtctccgtgacaggtccttcgnggacgcctaaccgttcgaacgtcgacttagttacgttacgtaaggttgggacgccggtaacggtcctaccggaggaaccgaacggtcctttagggacggttgggtacgtagggggaacgtacgttaccggtacccttaggttccggtactaaccgaacccgtaaacctaaaccgtaccgaccgaacgaacggtaacgttcccgaagggtaccaacgtaccgtaccaaccgtacgtaaaccggaccggtaaaacgaaaacgttaaccggaaactaccgtaagttaaaccgtcgtaacgggaactaccgttaacgaaccgtacggtccttacggtacgtacgttcgtaaccggtaacgggtaaccgtacggtttaaccgttcgttaaccgtttaggaccgttacgggtacgtaaggttaactttaacggtaacttaacgtaaacgtcgttaccgtacctttttacccgtaccgttccctttacccgttcgtacgttccggacggttaacccgtcggttaaccccggaccgttacccgtcccgttacccg

SEQ ID NO: 104306 - DNA, 1200 bp, Homo sapiens
  misc_feature: GYAE6OF01CVGVS.17.34.D01.1.454.CMB.1.raw
tcagcgtagactagcacgaccggtgctcgatttagatcgtctgtgttgggttgggacaaaacaaccagattcctcctctaaagaacgcccctgggagcacagctcatcaccatggactggacctggacggttccttctttggtggtggcagcagctacgaggtcgtccacgtcccaggtccgtaggttggtcgactaagtcggtggggacttggaggtgaaacgcgtccggtcgggtccgtgggtggacgggttcctccgtcgacgacggtcttacggtggacgtcctaccgttcgacgtcgtaacgttacgtttacgtttcgtaaggtttggggtaccggtccgggtaaccggggtcccttacggtacgggtaaaccggtacgggttacccggtttaggggtaggttacggggtaacgggtaacggggggtaaacggttcccggttacccggtttacccgttaacggtttacccgggtttaacggaaaaccccgtaaaccccgtaaaaccccgtaaaacccgttacccgggtaaaaccgtaaaccgggttaaaaccgggttaaaacccgggtttacccggggaaaccgggggtaaccgtaaaaccccgggttaaacccctaaccccggttaaaccccggtaaaacccgggttaaacccccggggaaaaacccgttaaaaaccgttaaaaaaccggttaaaaccccgggttaaaacccgtaaaaccgtttaaaccgggtttaaaccgtttaacccggggtaacgggtaaaacccgtttaacccgggttaaacggtaaaacccccgggttaacccggttaccccgttaaccgggtttaaacccgttaaccggttaccggggtttaaaaccggggaacccggggtttaaaccccggggttttaacccggtttaccccgtttttttaaaaccccggttttcggtaaccggggttttaccgggtaacgggggtaaaccggtttaaaacgggtttaaacgtttttaaaaccccgggtttaaattaaaaaccccggttaacccccgttttaagttttaacccccggttttttaacccctttttttaaacccccgtttttaaacccccccggtttacccccccgtttttaaacccggttttcccggtttaaaacccccggggggtttttcccccggggtaaacccgggggttttaaacccccccggg

SEQ ID NO: 104307 - DNA, 769 bp, Homo sapiens
  misc_feature: GYAE6OF01EHIG2.17.34.D01.1.454.CMB.1.raw
  modified_base (256)..(256): a, c, t, g, unknown or other
  misc_feature (256)..(256): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggaggttcctctttgtggtggcagcagctacgaggtgtccagtcccaggtccaggttggtgacaatcgtggggctgaggtgaagacgcgtggtccgtcggtgacgggtctcctgacacggtcttcgnggacggcctaccttcagcgtacttattagtttcgaaggttgggtcgcggaccgggtcctcgtaggacgtaggtccgttaggacggttggacggtggggaacgacgttccggttacctagttcggtacgaaccaacctaacccgaaactaccgacaagaacgtaacgtccggaggaccacgtaccaccgacctaacgtaccggaacgaactaaactaacgaactaacgtaagttactacggtaggaacgtctaacgaaccgacgtcctcgtactacgttacggacgacgggtaccgtaccgggttactttaccggttaacgttccggttaggtacgggtaacgttaacgggttaagttaaacctttaacgtaacttaaacccgttacgtttaccggtttccctttttaacccgttttaccccctacccgtttcccctttaaccggtacccggttttaccggacccggggttacccttaaccgggtttaccccgggtaacccccgttaccccggg

SEQ ID NO: 104308 - DNA, 774 bp, Homo sapiens
  misc_feature: GYAE6OF01BUVW0.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggagttcctctttgtggtggcagcagctacaggtgtccagtcccaggtccagttggtgcaatctggggctgaggtgaagaccgccgtgggtcctcggtgacgggtctcctgcaaggcttcgtggagcaccttcagcgactatagttcaagttggtgcgacggcctgtggacagcgttgagtggagtggaggtctccgtccgagtcgtacgaccacaaccaactcgactacagaacgttccgaggcacggactaccgaacccgaacgtaacccggaagaaacctaaaacgttaaaccgaacctaacgttaagttaaactccggttagggaaccgtacgtaacggaacctacggtacccgtttagtaaccctaagtaccgtaacgggtaaccggtacccggtaaccgggttccctttaccggtttaccgtttccgttacgggtacggtacgggttaaagggttaacgttaaacgtttaaccgtaaacgttaaccgttacctttaccgttacccgtttttacccccgttttaaccttacccccgtttaccccgtttccggttaacccgtttcccgggttaccgggttacccgttaaacccggttaccccccgggtaacccccggtttccccgtaacccccggtttacccccg

SEQ ID NO: 104309 - DNA, 1048 bp, Homo sapiens
  misc_feature: GYAE6OF01EK7FE.17.34.D01.1.454.CMB.1.raw
tcagcgtagactagcacgaccggtgctcgatttagatcgtctgtgttgggtttggggatcacaaaacaaccagattcctcctctaaagaacgcccctgggagcacagctcatcaccatggactcggacctggacggttcctctttgtggtggcagcagctacgaggtgtccacgtcccgaggttccgaggttggtgactaagttcggtgggggcttggaggtacggaacgaccggtcccggttcggggttcccgttcggggtcggaacgggttcctccgttaggaccgtaaggtcctttacggcgggacggtccctaccgttcgacgtaccgtaacttaagtttacgtttacgtaaggtttcggggtacggaccgggtaccgggtaccctaggtaacggggtaacccgtaacgggttccggtttaggggtacgggttacggggtaaggggttaacgggggaaaaccgggttccgtttacccggttaccccgtttaaggttttcccggttacggaaacccaacccgtaaacccgaaaccgttaccgacctaacgtaacgggtaacggtacccggacgggtaacaacggtaccctaaccgaaccgtaaccggttaaacccgggaacgtaaaaccgttaaacgttaaacccgaaccgtaaaccgttaaagtttaaccgtacggtacggtaacgtaacgttaaaccggaaccgttaccggtaacccgtttacgtacccgtttaaacgtacccggggttaaaggaaccgggtaacccgggttaacgggtttaccctttaaccgtttaaccggtttggttaaacccggggttcggtaaacccggggttaaagggttaagtttaaaccccgttaaacttaaaccggttaaaaccgttcgttttaaacccgttttaccccgtttttttacccccgttaaaccccgttacccgtttttaccccgggttaacggttacccggtttttaacccggggtccggttaaacccggtacccccgggttttaaacccccggggtaaccccgttttacccccggg

SEQ ID NO: 104310 - DNA, 719 bp, Homo sapiens
  misc_feature: GYAE6OF01DJPIO.17.34.D01.1.454.CMB.1.raw
tcagcgtagactagcacgaccggtgctcgatttagatcgtctgtgttgggtttggggacaaaaacaaccagattcctcctctaaaagaagcccctgggagcacagctcatcaccatggactggacctggaggttcctctttgtggtggcagcagctacaggtgtcccagtcccaggtccaggttggtgcaatcgtggggctggaggtgaagcgccgtgggtcctggtgagggtctcctgcagcttcgtggaggcacctcgagcgtactattagtttcaagttgggtagcggaccggtcctcgaggaccgaaggtccttggaggtacgggaggtaggggaagtcgtccgtacccgtattacggtcaacgaaccaacccgtaaacgtaccgacaacgaaggtaacgttccggaggacagacctacaaccacgtaaaccgacgtaaactaaaacgtaaccgaacaactaacgtaactcgtaggaactacgtaacgaacgacgtccgtgtaccgtagtaccgacggacggtaccgcgggttacttcgttactcgtacggtcggtacgtacggtaattacgttactaactaaccgtctacgtttacccctttaccttttaaacccgtcccctttcccgttcgttaaccccgtttcgggttcccgggtaaccgttaaccggttacccccggggtaaccccgttcccccgttaacccggttccccc

SEQ ID NO: 104311 - DNA, 728 bp, Homo sapiens
  misc_feature: GYAE6OF01CF94G.17.34.D01.1.454.CMB.1.raw
  modified_base (161)..(161): a, c, t, g, unknown or other
  misc_feature (161)..(161): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggaggttcctctttggtggtggcagcagctacaggtntccagtccccaggtccagttggtgcaatcgtggggctgaggtgaagcgccgtgggtcctgggtgagggtcctccgtgcgaggtctcgtggagccacttcgagcgactatagttactaagttgggtgcggacggcctcgtggacacggtccttaggacgtgggagtaggggaaggtacgtccgttcccgtacgttccgtacgaactaccaaccgaaaaccgtaccgacaaccgtacgaacgttcccgaggacacgaccgttacaaccacgtaaccgacggaaactaaacttaaacgaacctaacgtaacgtttaactacgttacggaacgtacgtaacggaactaaccgtccttacgtacctagtccgtacggaacggtacgaccggttacttacgttaccttcgtggtacgtacggtaaggtaagttaaacgttactaaacgtaaccttacgtacgttcctttacccgttttacccgtacccttaccctttaccggttaccttacccggttacgggtacccgtacgttaccccgggtacccggttcccgtacccggtttacccccgg

SEQ ID NO: 104312 - DNA, 979 bp, Homo sapiens
  misc_feature: GYAE6OF01DMVHF.17.34.D01.1.454.CMB.1.raw
tcagcgtagactagcacgaccggtgctcgatttagatcgtctgtgttgggtttggggatcacaaaacaaccagattccctcctactaaagaagcccctgggagcacagctcatcaccatggactggacctggacggttccttctttggtggtggcagcagtctacgaggtctccacgtacccgaggtcctaggttggtgactaagtcggtgggctggaggtgaacgcgccgtcgggtcctcggtaggtaggtccctcgtcggacgaacggttccttacggtaggaccggtcctaccgttacgacgtacgtaaccttagttacgttttacgtaaggttcgggtacggaccggtacccggtccgttaccggtaacgggaaccgtaacgggtccgtttaagggacgggtaggaaacgggttaggggaacggttacggttcccgtaccgtttacgtaccggttaccgaaaccgtaacccgaaaccctaaaccgtaccgaccgtaaccgtaaacggtaacccggttaccggaacgggtaacccgtaaccgtaaccctaacccgtaacccgtaaacggtaaaccccggtaacgtaaaaacccttaaacgtaaaacccgtaaaccgtaaccggtttaacgttaaccgtaccggtaacggtacgtaacgtaacgtaaccgtacgttaacccgtaccgttaacgtaccggttaccgtaacggggtaaccgaacccgggttaaccgggtttccctttaaccgtttaccgtttacggttacggttaccggtaacgggtaacggttacgttaaacgtttaaaccctaaccgttaaaccgttaccgttacccgttttacccgttttaccccgttttacccgttaaccccccgttttacggtttaaccccggtttacccggttttaccggggttacccggttaaccccggtaaccccgggttaaccccccggttaaccccggttaccccccgg

SEQ ID NO: 104313 - DNA, 777 bp, Homo sapiens
  misc_feature: GYAE6OF01DNXYR.17.34.D01.1.454.CMB.1.raw
  modified_base (262)..(262): a, c, t, g, unknown or other
  misc_feature (262)..(262): n is a, c, g, or t
  modified_base (611)..(611): a, c, t, g, unknown or other
  misc_feature (611)..(611): n is a, c, g, or t
  modified_base (616)..(616): a, c, t, g, unknown or other
  misc_feature (616)..(616): n is a, c, g, or t
tcagcgtagactagcacgaccggtgctcgatttagatcgtctgtgttgggtttgggatcaacaaaacaaccagattcctcctactaaagaacgcccctgggagcacagctcatcaccatggactggacctggagttcctctttggtggtgcagcagctacgaggtgtaccagtcccaggtccagttcggtgcaatcgtaggggcgtgaggtagaagacgccgtggtccgtcggtgagggttctcctagacgaaggtccttgngggacgtccgtaccgttacgagtcgtaaccttagttaagtttacgtaaagttgggttaacgcgggtaaccggtacctacgtaccggtaacgaacgggtccgtttaggacggttagggaaggttacggggaacgtacgttccgtaccgtaacgttacggttacgaaccaacgaaccctaaaacctacgaccgtaaacgtaaacgtaacggttacccgaacgggtacgaacgtaacccgtaccgaaaccttaaaccgtaaaccggaacgtaaaacctaaacgtaaacgaaactaaccgttaagttaactacggtacggaagtaactaacggaacgtacgtacgtaccgtanacgtntaacgggacgtaaccgacggttagttacctactttcgtacgtcgacgtaaggtacgttaacttacttaacaaccttcgtacttacccgtttacctttaccaaacctttcccgttagtaccgttcggaacgtaccgtaacggtacccggtacccgttaaccg

SEQ ID NO: 104314 - DNA, 844 bp, Homo sapiens
  misc_feature: GYAE6OF01AIWFS.17.34.D01.1.454.CMB.1.raw
  modified_base (281)..(281): a, c, t, g, unknown or other
  misc_feature (281)..(281): n is a, c, g, or t
tcagcgtagactagcacgaccggtgctcgatttagatcgtctgtgttgggtttggggatcacaaaacaaccagattcctcctctaaagaagcccctgggagcacagctcatcaccagtggactggacctggaggttcctcgtttgtggtggcagcagctacaggtgtccaggtcccaggtccagttggtgacaagtcgtgggggctggaggtagaacgaccggccgttggggtcccttcggggtaggtacggggtctccgtaggcgaacgggtcctttcgngggacgtacctaccgttacgagtaccggaacttagttacggtttaccgaaaggtttcggggtcgtaccgggtaccgggtccccgttcgtacgggtaaccgaaagggttcccgttaggttaccgggagggtacgggttacggggaaagggttccttaaccggtcccgtttacggtacggtttacggacctaaccaacccgtaaaccgtacgtaccaaacgtacgaacccggtttaccgaaccggggttcaacggtacccgttaccgaaacccgtaacgtaacccgggtacggtaaaccttaaaagttaacccggaacttaaccgaacggtttaactacggtaacgggtaacgtacgttaacgaaccgtacgttaccgtaaccgtacgtaccgtacgttagggaacgtaccgaacgggtttctaacccgttacgttaccgggtagtacggtacggtaagtaacgttaacgttagaacgtacgtaccgttaacgtcctttacttaacggtcccttacgttaccgtacgttaccggtcggaacctcgggtaccgtccccggttaacg

SEQ ID NO: 104315 - DNA, 792 bp, Homo sapiens
  misc_feature: GYAE6OF01EHX4Y.17.34.D01.1.454.CMB.1.raw
  modified_base (260)..(260): a, c, t, g, unknown or other
  misc_feature (260)..(260): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacgaggtgtccagtcccaggtccagttggtgcaatcgtggggctggaggtgaagacgccgtcgggttcctcgggtgacgggtctcctgcgaacggtcttcgngggacggcctaccttcagcgactattagtttcaagttgggtacgcggacggtcctcgtaggaccgaaggtccgttggaggttaggaggtaggggaaggaccgttccgttacccttagttcggttacgacctaaccaacccgtaaaccgtaaccgaccaacgtacgtaacggttaccggtaacggaccgaacgtaaccgtaccaacccgtaacgtaacccggacgtaaacctaaaacgttaaaccgaaccgtaaacgtaacgttaaacgtacgtacgggtaacgacgttacgaaaccgtaccgtaccgttacgtaacctacgttaccgaacggtacggaacccggtaccgggttacctttccggtttaacctttacgggtgttacggtcggtaacggtaacgtttaaacgtttaactaaacgttacctaaccgttcgttaccctttttaaccccttttacctcccctttaccgttaccgttaccgttccggtaccgggtaccctaccggttaccccggaccccggtttacccg

SEQ ID NO: 104316 - DNA, 576 bp, Homo sapiens
  misc_feature: GYAE6OF02I8LMO.17.34.D01.1.454.CMB.1.raw
  modified_base (517)..(517): a, c, t, g, unknown or other
  misc_feature (517)..(517): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
tcagcgtagactagcacgaccggtgctcgatttagatcgtctgtgttgggtttgggtacgagtttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcatttcgctacttctgatacctccagcatgcctcacacgcacaccttcacacggcttacagaaccgctcccctaacccaacaacgcataacgcgtcgctgccgcacgcttcgtncagtcggtttacnccccgtttnacttccttcccgcctacttcctgacttacgtctaccg

SEQ ID NO: 104317 - DNA, 539 bp, Homo sapiens
  misc_feature: GYAE6OF02I6OMH.17.34.D01.1.454.CMB.1.raw
  modified_base (386)..(386): a, c, t, g, unknown or other
  misc_feature (386)..(386): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgnggaacaaataacgaacacagttaatctaggagctagaacagcctgtcatctgaggacacggcttctacttctgtgcgaggagtaattactatacactgcttccttttacaccttcccttgtacttcgtcgggcctacgtcggaccccggtccg

SEQ ID NO: 104318 - DNA, 564 bp, Homo sapiens
  misc_feature: GYAE6OF02GIXB4.17.34.D01.1.454.CMB.1.raw
  modified_base (508)..(508): a, c, t, g, unknown or other
  misc_feature (508)..(508): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttcggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggngcatcggtttagccccgttttcacttccttcccgcctactcctgacttagtctacg

SEQ ID NO: 104319 - DNA, 536 bp, Homo sapiens
  misc_feature: GYAE6OF02HWM9C.17.34.D01.1.454.CMB.1.raw
  modified_base (385)..(385): a, c, t, g, unknown or other
  misc_feature (385)..(385): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaaggccttgagtggatgggaagatcgtcctatcgttgacacaccaaatacgcacagaagttccagggcagactcaccataaccgnggaacaaattaacgaacacagttaatctaggagctagaacagcctgtcatctgagacacgggcttactacttctgtgcgaggagtaattactataacactgctccttttacaccttcccttgacttcgtcgggtccatcggacccgtaccg

SEQ ID NO: 104320 - DNA, 553 bp, Homo sapiens
  misc_feature: GYAE6OF02HPGI9.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcaacagaagttccagggcagactcacataaccgcggacaaattaacgaacacaagttaatctaggagctagaacagcctgtcatctagagacacggcttctacttctgtgcgaggagtaattactaataactactgtcttaccgttttactacccttcccttcgtacctttcgtcgggtccagtcggaaccccgtcacccgtcc

SEQ ID NO: 104321 - DNA, 540 bp, Homo sapiens
  misc_feature: GYAE6OF02I2JRE.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggaacaaataacgaacacagttaatctaggagctagaacagcctgtcatctgaggacacggcttctacttctgtgcgaggagtaattactatacactgtcttccttttacaccttccttgtacttcgtcgggcctacgtcggtaccccgtccg

SEQ ID NO: 104322 - DNA, 553 bp, Homo sapiens
  misc_feature: GYAE6OF02G37R6.17.34.D01.1.454.CMB.1.raw
  modified_base (384)..(384): a, c, t, g, unknown or other
  misc_feature (384)..(384): n is a, c, g, or t
  modified_base (460)..(460): a, c, t, g, unknown or other
  misc_feature (460)..(460): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgngaacaaattaacgaacaacagttaatactggagctagaacagcctagtacactctgagacgacggtcttctacttntgtgcgaggtattaatactaataacatcgtacttacctttactacccttcctactacttcgtcggcctagtaccggtacccgtccacccgtcc

SEQ ID NO: 104323 - DNA, 564 bp, Homo sapiens
  misc_feature: GYAE6OF02INYM8.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcctatcgttgacacaccaaactcgcacagaacttccagggcagactcaccataaccgcggacaaattaacgaacacagttaatctaggagactagaacagcctgtacatctgacggacacgggtcttcgtacttctgtgcgaggtagtaattactataacactgtaccttaccttttaccacccttcccttgtacctttcgtcgggtcctagtaccggtaaccccggtcctacccgtccg

SEQ ID NO: 104324 - DNA, 527 bp, Homo sapiens
  misc_feature: GYAE6OF02HZU3G.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcacataaccgcggacaaataacgaacacagtaatctgagctgaacagcctgtcatctgagacacggcttctacttctgtgcgagagtaatactataacactgctccttttactacctccttgacttctcgggcctatcggaacccgtcaccgtcc

SEQ ID NO: 104325 - DNA, 547 bp, Homo sapiens
  misc_feature: GYAE6OF02IP5WO.17.34.D01.1.454.CMB.1.raw
  modified_base (322)..(322): a, c, t, g, unknown or other
  misc_feature (322)..(322): n is a, c, g, or t
  modified_base (385)..(385): a, c, t, g, unknown or other
  misc_feature (385)..(385): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaccaaactacgcacagaagttccagggcagactcaccataaccgngaacaaataacgaacacagttaatactaggagctagaacagcctgtcatctgagacacggcttctacttctgtgcgaggagtaattactatactactcgtcttaccttttacacccttcccttgtaccttcgtcgggtacctacgttccggtaccccgtccg

SEQ ID NO: 104326 - DNA, 544 bp, Homo sapiens
  misc_feature: GYAE6OF02HZZYJ.17.34.D01.1.454.CMB.1.raw
  modified_base (388)..(388): a, c, t, g, unknown or other
  misc_feature (388)..(388): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtgggatgggaaggatcgtccctatcgttgacacaccaaactacgcacagaagttccagggcagactcaccataaccgnggaacaaattaacgaacaacagttaatctggagctagaacagcctgtcatctgaggacacgggcttctacttctgtgcgaggagtaattactatacactgcttaccttttacacccttccttcgtacttcgtcgggcctacgttcggacccgtccg

SEQ ID NO: 104327 - DNA, 542 bp, Homo sapiens
  misc_feature: GYAE6OF02IK8K0.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcgacaaataacgaacacagtaatctaggagctagaacagcctgtacatctgaggacacggcttctacttctgtgcgaggagtaatactataacactagtcttccttttacaccttccttgtaccttcgtcgggcctacgtacggacccgtccaccgtcc

SEQ ID NO: 104328 - DNA, 547 bp, Homo sapiens
  misc_feature: GYAE6OF02H9PMS.17.34.D01.1.454.CMB.1.raw
  modified_base (417)..(417): a, c, t, g, unknown or other
  misc_feature (417)..(417): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggggcctctggacaaggccttgagtggatgggaaggatcgtccctatcgttgacacaccaaactacgcacagaagttccagggcagactcaccataaccgcggacaataacgaacacagtaatctagganctagaacagcctgtcatctgagacacgggcttacgtacttctgtgcgaggagtaattactatacacgtgcttaccttttacaccttccttagtaccttcgtacggggtcctacgtaccggaccccgtccg

SEQ ID NO: 104329 - DNA, 543 bp, Homo sapiens
  misc_feature: GYAE6OF02F8OMB.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtcctatcgtgacacaccaaactacgcacagaagttccagggcagactcaccataaccgcgacaaataacgaacacagttaatctaggagactagaacagcctgtcatctgaggacacggcttctacttctgtgcgagagtaattactatacactgtcttaccttttacctaccttcccttgtacttcgtcgggtcctacgttaccggaccccggtccg

SEQ ID NO: 104330 - DNA, 565 bp, Homo sapiens
  misc_feature: GYAE6OF02I1R4F.17.34.D01.1.454.CMB.1.raw
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctntggacaaggccttggagtggatgggaagntcgtccctatcgttnacacaccaactacgcacagacttcaggcagactcaccactaaccgacgaacaaataacgaaacacagtaatactagacgcgtagaacacgctgtacacgtctgaggacgacggcttacctacttctaggtgcgaaggacgttaaattactatactactcgtcttacccttttactaccctccctttagactttccgtacgggacctacgtacggtacccggtacccg

SEQ ID NO: 104331 - DNA, 553 bp, Homo sapiens
  misc_feature: GYAE6OF02HCALI.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagccgactatagtttcaattgggtgcgacgggcctctggacaaggccttgagtggatgggaagatcgtcctatcgttgacacacaaactacgcacagaagttccagggcagactcaccataccgcgaacaataacaacacagttaatctagagctagaacagcctgtcatctgagacacgggtcttactacttctgtcgcgaggtagtaattactatactactacgtccttaccttttacctacccttcccttacgtacctttcgtcgggtacctacgtccggaccccgtaccg

SEQ ID NO: 104332 - DNA, 527 bp, Homo sapiens
  misc_feature: GYAE6OF02ITX34.17.34.D01.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (524)..(524): a, c, t, g, unknown or other
  misc_feature (524)..(524): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggcctcagtgaaggtctcctgcaaggcttctggattcacgtttacctcctatagtatcaactgggtncgccaggccgctggacaacgcctgagtggatgggatgggcgaaccctaanactggtgtcacagtgtcttcacccatcctccgggacagacttaccatgaccacgaactcctacataaacacagcctaacatggagttagaggagcctgacatctgacgacacggccgtctattactgtcgcgagacgtcccacgatccggtagacgcctacggcaggccgtcttgacttcgcgggccagggacnccg

SEQ ID NO: 104333 - DNA, 544 bp, Homo sapiens
  misc_feature: GYAE6OF02GN316.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcgacaataacgaacacagttaatctaggagctagaacagcctgtcatctgagacacgggtcttctacttctgtgcgaggagtaattactatacactcgtcttaccttttacacccttcccttgtaccttcgtcgggtcctacgtcggaccccgtaccg

SEQ ID NO: 104334 - DNA, 554 bp, Homo sapiens
  misc_feature: GYAE6OF02JULZV.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggctctggacaggccttgagtggatgggaagatcgtcctatcgttgacacaccaaactacgcacagaagttccagggcagactcacataaccgcgacaataacgaacacataatctgagcagaacagcctagtacatctagacggacacgggtcttctacttctgtcgtacgagagtaacttacgtatactactacgtcttaccttttacacccttcccgtttgtacctttcgtacgggtacctacgttaccggaccccggttaccg

SEQ ID NO: 104335 - DNA, 538 bp, Homo sapiens
  misc_feature: GYAE6OF02GE7DD.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcctatcgttgacacaccaaactacgcacagaagttccagggcagactcacataaccgcgacaaataacgaacacagtaatctggagctagaacagcctgtcatctagagacacgggcttctacttctgtgcgaggagtaattactataacactgcttccttttacaccttcccttgtcttcgtcgggtcctagtcggaaccccggtcaccgtcc

SEQ ID NO: 104336 - DNA, 549 bp, Homo sapiens
  misc_feature: GYAE6OF02FJNW8.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaatttgggtgcgacgggcctctggacaaggccttgagtggatgggaaggntcgtccctatcgttgacacaccaaactacgcacagaacgttccagggcagactcaccataaccgcgaacaataacgaacacagtaatactgagactagaacagcctgtacatctgaggacgacgggcttctacttctgtgcgagagtaattatatacactgtcttaccttttacacccttcccttcgtacttcgtcgggtcctacgtaccggtaccccggtcccg

SEQ ID NO: 104337 - DNA, 537 bp, Homo sapiens
  misc_feature: GYAE6OF02FNO4Z.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaataacgaacacagtaatctggagctgaacagcctgtacatctgaggacacgggcttctacttctgtgcgaggagtaattactatacactgtctccttttacaccttcccttgtacttcgtgggtccacgttcggaccccgtccg

SEQ ID NO: 104338 - DNA, 545 bp, Homo sapiens
  misc_feature: GYAE6OF02INCHZ.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaccaaactcgcacagaagttccagggcagactcaccataaccgcgaacaaataacgaacacagttaatctaggagctagaacagcctgtcatctgaggacgacgggtcttctacttctgtgcgaggagtaattactatacactgtcttaccttttacaccttaccctttacttcgtcgggtcctagtcggtaccccgtctacccg

SEQ ID NO: 104339 - DNA, 561 bp, Homo sapiens
  misc_feature: GYAE6OF02F0GWK.17.34.D01.1.454.CMB.1.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctaccaacacgcataagcgtcgctgccgcagcttcggtgcgatcggtttacgccccgttacactccttcccgcctactctcgtacctagtcc

SEQ ID NO: 104340 - DNA, 549 bp, Homo sapiens
  misc_feature: GYAE6OF02GIWXT.17.34.D01.1.454.CMB.1.raw
  modified_base (334)..(334): a, c, t, g, unknown or other
  misc_feature (334)..(334): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatccctccgggacacgtacttaccatcgacccacgaacctcctaccaataaaccacacgcctacatggagttgaggacgcctgacatctgacgacacggcctctagttactgtgcgagacgtcccacgacgtccggtgacgccgtaacggcacggccggtcctttggacctttcggtcggggcctacgggg

SEQ ID NO: 104341 - DNA, 625 bp, Homo sapiens
  misc_feature: GYAE6OF02I5BQ1.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattggtgcgacggcctctggacaggccttgagtggatggaagactcgccgatcgtgacacacaactcgcacagaacgtcgaggcacgactcacacgtaaccgcggaaacaaacgttaacgaacaacgtaacgttaactcgtaggacgctaacgaacacgtaccgtgactacgtcgtaggacgacgacggtcttaccgttacttctaggtgaccggtaaggtaacgttaacttacgtaacgtaactacgttcgtacctttaccgttttaacctacccttaccgttacgttaccgtttacggtacggggtacccttaaggtacccgggtaaccccggttacgtaccccgttacccg

SEQ ID NO: 104342 - DNA, 569 bp, Homo sapiens
  misc_feature: GYAE6OF02I89TX.17.34.D01.1.454.CMB.1.raw
  modified_base (280)..(280): a, c, t, g, unknown or other
  misc_feature (280)..(280): n is a, c, g, or t
  modified_base (409)..(409): a, c, t, g, unknown or other
  misc_feature (409)..(409): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtncgacgggcctcgtggacaaggccttgagtggatgggaagatcgtcctatcgttgacacaccaaactacgcacagaacgttcagggcagactcaccataaccgcggaacaaattaacgacacaagttaancgtaggagactagaacacgcctagtacatctagagacacggcttctacttctgtcgagagaagtaatactaataacactgtaccttaccttttaaccaccttcccttagtaccttcgttacgggcctacgtaccggtaaccccggtactacccgtacccg

SEQ ID NO: 104343 - DNA, 582 bp, Homo sapiens
  misc_feature: GYAE6OF02HGGNF.17.34.D01.1.454.CMB.1.raw
  modified_base (247)..(247): a, c, t, g, unknown or other
  misc_feature (247)..(247): n is a, c, g, or t
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggagcaccttcagcgactatagtttcaattgggtncgacgggcctctggacaaggccttgagtggatgggaaggntcgtccctatcgttgacacaccaaactacgcacagaagttccagggcagactcaccataaccgcggacaaattaacgaacacagtaatctggagctgaacagcctgtccatctagaggacacgggtcttaccgtacttcgtagtcgacgagggtagtaagttactaataactacgttcgtcctttaccgtttttacctaacccttccctttagtacctttccgtcggggtaccctaacgttaccggtaaccccggtaccg

SEQ ID NO: 104344 - DNA, 547 bp, Homo sapiens
  misc_feature: GYAE6OF02IAVZC.17.34.D01.1.454.CMB.1.raw
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaggccttgagtggatgggaagatcgtcctatcgttgacacaccaaactacgcacagaagttccagggcagctacacataaccgngaacaaataacgaacacagttaatctaganctagaacagcctgtcatcctagacggacacgggtcttactacttctgtcgcgaggtaagtaattactatacactgtcttccttttacacccttccttcgtacttcgtcgggtaccctagttccggacccgtccg

SEQ ID NO: 104345 - DNA, 555 bp, Homo sapiens
  misc_feature: GYAE6OF02HRUBY.17.34.D01.1.454.CMB.1.raw
  modified_base (386)..(386): a, c, t, g, unknown or other
  misc_feature (386)..(386): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataccgngaacaaataacgaacacagtaatctgagctagaacagcctgtcatctgagacacgggcttctacttctgtgcgaggataattactataactactacgtcttacccttttacaacccttcccttgtacctttccgtcgggtaccctaacgttccggtaaccccgtacccg

SEQ ID NO: 104346 - DNA, 544 bp, Homo sapiens
  misc_feature: GYAE6OF02IZUC3.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaaggccttggagtggatgggaaggatcgtccctatcgttgacacaccaaactacgcacagaagttccagggcagactcaccataaccgcggaacaaattaacgaaacacagttaatctggagctagaacagcctgtacatctcgaggtacacgggcttactacttctgtgcgaggagtaatactatacactgcttaccttttacaccttcccttgtaccttctgggccagtcggaccccgtccg

SEQ ID NO: 104347 - DNA, 550 bp, Homo sapiens
  misc_feature: GYAE6OF02IOSZU.17.34.D01.1.454.CMB.1.raw
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgccaagggcttctggaggcaccttcagcgactataatttcaattgggtncgacgggcctctggacaaggccttgagtggatgggagatcgtccctatcgttnacacaccaaactacgcacagaacgttccagggcagactcaccataaccgcggaacaaattaacgaacacaagttaatctaggagactagaacagcctgtcatctgaggacacgggtcttactacttctgtgcgaggagtaatactatacactgcttaccttttaccaccttcccttgtacttcgtcgggcctacgtccggaccccggtccg

SEQ ID NO: 104348 - DNA, 544 bp, Homo sapiens
  misc_feature: GYAE6OF02F620S.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggaacaaattaacgaacacaagttaatctaggagctagaacagcctgtcatctgaggacacgggcttctacttctgtgcgaggagtaattactatacactagcttaccttttacaccttcccttgtaccttctcgggcctacgtcggaccccggtcc

SEQ ID NO: 104349 - DNA, 566 bp, Homo sapiens
  misc_feature: GYAE6OF02HE1G1.17.34.D01.1.454.CMB.1.raw
  modified_base (399)..(399): a, c, t, g, unknown or other
  misc_feature (399)..(399): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccacgtcccaggtccagttggtgcaatcgtggggctgaggtgaagacgccgtgggtcctcggtggagggtcctcctgcgaaggtcttcgtggaggcctaccttcagcgactattagttcaagttgggtgcggacgggcctcgtggacaaggccttgagtggagtgggaagatccgtcctatcgttgacacacaaactcgcacagacttccgagggcagactcaccataaccgngaacaattaacgaacactaagttaatcgtagagtcagaacagcctgtcatcgtagacgacgacggtcttctacttctgtgcgaggataattactatactatacgtcttacctttactacccgttccttacgtacttcggtcggtcctagtaccggacccgttacccg

SEQ ID NO: 104350 - DNA, 552 bp, Homo sapiens
  misc_feature: GYAE6OF02G5WTW.17.34.D01.1.454.CMB.1.raw
  modified_base (487)..(487): a, c, t, g, unknown or other
  misc_feature (487)..(487): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcaacagaagttccagggcagactcaccataaccgcggaacaaattaacgaacacagttaatctaggagactgaacagccctgtacatctagaggacacgggcttctacttctgtgcgaggtagtaattactataacnctgccttaccttttaccaccttcccttgaccttcgtcgggcctagtccggacccgtcacccgtcc

SEQ ID NO: 104351 - DNA, 556 bp, Homo sapiens
  misc_feature: GYAE6OF02ILZ87.17.34.D01.1.454.CMB.1.raw
  modified_base (407)..(407): a, c, t, g, unknown or other
  misc_feature (407)..(407): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
  modified_base (527)..(527): a, c, t, g, unknown or other
  misc_feature (527)..(527): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgccggccaacatagccttctcccgtcccccttcgcagtaacaccaagtacaggaatattaacctgtttcccatcgactacgcctttcggcctcgccttaggggtcgactcaccctgccccgattacgtgacagaacctggtctccggcgagcgggcttttcaccgtctttatcgttactatgtcagcattcgcacttntgatacctccagcatgcctcacagcacaccttcacagctaacagaacncctccctaccaacaacgcanaagcgtcgactgccgacagccttcgtcgcaagttggttaacgccccgttttnactcgttcccgcactctgacttagctacg

SEQ ID NO: 104352 - DNA, 566 bp, Homo sapiens
  misc_feature: GYAE6OF02HZETH.17.34.D01.1.454.CMB.1.raw
  modified_base (244)..(244): a, c, t, g, unknown or other
  misc_feature (244)..(244): n is a, c, g, or t
  modified_base (415)..(415): a, c, t, g, unknown or other
  misc_feature (415)..(415): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggcaccttcagcgactatagtttcaattgggtgcgacgggcctctggacaaggccttgagtggatgggaaggatcgtcctatcgttgacacaccaaactacgcacagaagttccaggcagactcacataaccgcgaacaaataacgaacacaagttaatacgtggagntagaacagcctgtacatctgacgacgacggcttctacttctgtgcgaggattaacttactaataacacttgtccttaccgttttacctacccttcccttagtacctttcgtcgggtacctagtaccggaaccccggttcctacccgttccc

SEQ ID NO: 104353 - DNA, 563 bp, Homo sapiens
  misc_feature: GYAE6OF02F9L4Q.17.34.D01.1.454.CMB.1.raw
  modified_base (328)..(328): a, c, t, g, unknown or other
  misc_feature (328)..(328): n is a, c, g, or t
tcagcgtagactagcacgaccggtgctcgatttagatcgtctgtgttggggtttgggggacaaaacaaccagattcctcctctaaagaagcccctgggagcacagctcatcaccatggactggacctggaggttcctctttgtggtggcagcaggctacaggtgtccagtcccaggtccagtttggtgcaatctggggctgaggtgaagacgcctggggtcctcgggtgggggtctcctgcaagggcttctggaggcaccttcagcgactatagtttcaattgggtgcgacgggtcctctggacaaggccttgagtggatgggaaggntcggtcctagtcgttgacacaccaaactacgcacagaagttccagggcagactcaccataaccgcggacaaattaaccgaacacagttaatctaggagctgaacagcctgtacatctgagacacggcttctacttctgtgcgaggagtaattactataacactgtcttaccttttacgtaccttccttagtacttcgtcgggtccacgtccggacccggtcgtaccgtcctcccg

SEQ ID NO: 104354 - DNA, 556 bp, Homo sapiens
  misc_feature: GYAE6OF02HLKDM.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcctatcgttgacacaccaaactacgcacagaagttccagggcagactcacataaccgcgacaaattaacgaacaacagtaatactaggagctgaacagcctgtcatctgagacacgggcttctacttctgtgcgaggagtaattactaataacactgtcttaccttttaactacccttcccttcgtacctttcgtcggggtccagttcgggaaccccggttccacccgttcc

SEQ ID NO: 104355 - DNA, 553 bp, Homo sapiens
  misc_feature: GYAE6OF02FZNP8.17.34.D01.1.454.CMB.1.raw
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtcctatcgttgacacaccaaactacgcacagaagttccagggcagctcacataaccgngacaaataacgacacagtaanctgagctgaacagacctgtcatctgaggacacggcttctacttctgtgcggagtagtaattactataacacttgtacttacctttttacaccttcccttagtactttaccgtcgggtcctagttccggtaaccccggttctacccggttccc

SEQ ID NO: 104356 - DNA, 555 bp, Homo sapiens
  misc_feature: GYAE6OF02G31RD.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaccaaactacgcacagaagttccaggcagactcaccataaccgcgaacaaataacgaacacagttaatctagagactagaacagcctgtacatctagaggacacgggcttctacttctgtcgcgaggagtaattactaatacactgtcttaccttttactacccttcccttgtacctttcgtcgggtcctacgttaccggtaaccccggtacccg

SEQ ID NO: 104357 - DNA, 549 bp, Homo sapiens
  misc_feature: GYAE6OF02HD2OC.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcacataccgcgacaaataacgaacacagttaatctagagactgaacagcctagtcatctgaggacgacggcttactacttctgtcgcgaaggtagtaattactatactactgtcttaccttttacacccttccgttagtacttcgtcgggtacctacgtccggaccccgtaccg

SEQ ID NO: 104358 - DNA, 565 bp, Homo sapiens
  misc_feature: GYAE6OF02FSQY9.17.34.D01.1.454.CMB.1.raw
  modified_base (508)..(508): a, c, t, g, unknown or other
  misc_feature (508)..(508): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttaattatgtcagcattcgcacttctgatacctccagcatgcctcacagcacaccttcacaggcttacagacgctcccctaccacaacgcataagcgtcgctgccgcagcttcggtncatggtttacgccccgtttcacttccttcccgcctactcctcgacttacgtctaccg

SEQ ID NO: 104359 - DNA, 575 bp, Homo sapiens
  misc_feature: GYAE6OF02GUK7Y.17.34.D01.1.454.CMB.1.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctaacaaacacgcataagcgtcgctgccgcagcttcggcgcagttggtttacgcccccgttttcacttcctttcccgccctacttccgtgaccttagtctaaccg

SEQ ID NO: 104360 - DNA, 604 bp, Homo sapiens
  misc_feature: GYAE6OF02HH5S8.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctctgcaaggcttctggagcaccttcagcgactatagtttcaattgggtgcggacgggcctctggacaaggtccttgagtggatgggaagntcgtcctatcgttgacacaccaaactcgcacagaacgttccgagggcacgactcaccataacccgacggaacaaattaacgaacacaagttaatcgtaggaacgactacgaacagacctgtacatcgtagagaccgacggtcttacgtacttctcgtgacgtaggtagttaattacctaataacgtacgtacgtcctttcccttttaacctaaccctttcccgttacgttaccgtttccggttcgggtaccctacgttacccgggtaacccccggttacccg

SEQ ID NO: 104361 - DNA, 532 bp, Homo sapiens
  misc_feature: GYAE6OF02H80MK.17.34.D01.1.454.CMB.1.raw
  modified_base (294)..(294): a, c, t, g, unknown or other
  misc_feature (294)..(294): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctntggacaaggccttgagtggatgggaagatcgtcctatcgttgacacaccaaactacgcacagagttccagggcagactcacataccgcgacaaatacaacacgataatcagagctagaacagctagtnatctagagcacggcttanctctgtagcgaggataagttactatacactgtcttacctttacaccttacccttgtacttcgtagggtccctagtaccggtacccgtacccg

SEQ ID NO: 104362 - DNA, 573 bp, Homo sapiens
  misc_feature: GYAE6OF02JZI0I.17.34.D01.1.454.CMB.1.raw
  modified_base (425)..(425): a, c, t, g, unknown or other
  misc_feature (425)..(425): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtacgacgggcctcgtggacaaggtccttggagtggatgggaagatcgtcctatcgttgacacaccaactacgcacagagtccagggcagactacaccagtaaccgcggaacaaataacgaacacaagttaatctaggagctagaacngactgacatctagagacacggtcttctactctagtcgcgaaggtagttaattctaataacactcgtaccttaccttttaccgaccttccttagtacctttcgtcgggtacctacggtaccggtaaccccggtctacccgttctacccg

SEQ ID NO: 104363 - DNA, 558 bp, Homo sapiens
  misc_feature: GYAE6OF02GLGQ3.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaacgttccagggcagactcaccataaccgcggacaaattaacgaacacattaatctggagctgaacagcctgtcatctgagacacgggcttctacttctgtgcgaggagtaattactaatacactgtcttccgttttactacccttcccttcgtacctttcgtcgggtcctacgttacggaaccccggttccacccgttcccg

SEQ ID NO: 104364 - DNA, 522 bp, Homo sapiens
  misc_feature: GYAE6OF02HYOK9.17.34.D01.1.454.CMB.1.raw
  modified_base (433)..(433): a, c, t, g, unknown or other
  misc_feature (433)..(433): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgactcctacataaacacagcctacatgattgagagcctgacatcngacgacacggccgtactattctgtgcgagacgtcccagtactccggtagacgcccgtacggcacgccggtcctttgaccgttcgcgggg

SEQ ID NO: 104365 - DNA, 544 bp, Homo sapiens
  misc_feature: GYAE6OF02FYJX4.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactcgcacagaagttccagggcagactcaccataaccgcggacaaattaacgaacacagtaatctggagctagaacagcctgtcatctgaggacacgggcttctactctgtgcgaggtagtaattactaataacactgcttaccttttacacccttcccttgtaccttcgtcgggccagtcggaccccggtcaccgtccc

SEQ ID NO: 104366 - DNA, 558 bp, Homo sapiens
  misc_feature: GYAE6OF02FXMXC.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagatcgtcctatcgttgacacaccaactacgcacagagtccagggcagactcaccataccgcgaacaattaacgaacacaagttaatcgtagagctagaacagcctgtcatctagagacgacggcttctacttctgtgcgaggtagtaatactatacactgtacttaccttttaacacccttcccttacgtacctttcgtcgggtacctacgtacggtaaccccggtccgtaccgttcccg

SEQ ID NO: 104367 - DNA, 543 bp, Homo sapiens
  misc_feature: GYAE6OF02FRVGQ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcgaacaaattaacgaacacagtaatctaggagctgaacagcctgcatctgagacacgggcttctacttctgtgcgaggagtaattactatacactcgtcttccttttacacccttcccgttagtacctttcgtcgggtcctacgtcggaccccgtccg

SEQ ID NO: 104368 - DNA, 546 bp, Homo sapiens
  misc_feature: GYAE6OF02HBJJJ.17.34.D01.1.454.CMB.1.raw
tcagcgtagactagcacgaccggtgctcgatttagatcgtctgtgttgggtttggggagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcacataaccgcggacaaattaacgaacacaagttaatctaggagctagaacagcctgtcatctagaggacacgggcttctacttctgtgcgaggagtaatactataacactgcttccttttacaccttccttcgtaccttcgtcgggtcctagttcggaccccggtcacccgtctccctctaccg

SEQ ID NO: 104369 - DNA, 556 bp, Homo sapiens
  misc_feature: GYAE6OF02F3ZSD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcggaacaaattaacgaacacagttaatctaggagctagaacagcctgtcatctgaggacacgggcttctacttctgtgcgaggagtaattactatacactagtcttacctttttaccacccttcccttagtacctttcgtcgggtacctacgttaccggaccccggtaccg

SEQ ID NO: 104370 - DNA, 569 bp, Homo sapiens
  misc_feature: GYAE6OF02F2GF5.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaagatcgtccctatcgttgacacaccaaactacgcacagaagttccagggcagactcacataaccgcgaacaaataacgaacacagtaatctggagactagaacagcctgtacatctagaggacacgggtcttactacttcgtgtgacgtagtagtaattactaatacactagtccttaccttttacctacccttacccgtttcgtactttccgtacggggtaccctacgtaccggtaccccggtacccg

SEQ ID NO: 104371 - DNA, 549 bp, Homo sapiens
  misc_feature: GYAE6OF02GN6PJ.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtccctatcgttgacacaccaaactcgcacagaagttccagggcagactcaccataaccgcggaacaaactaacgaacacaagttaatactagagctagaacagcctgtcatctgaggacacgggcttactacttctgtgcgaggagtaattactatacactgtcttaccttttacacccttcccttgtaccttcgtcgggtcctacgtcggaccccggtaccg

SEQ ID NO: 104372 - DNA, 564 bp, Homo sapiens
  misc_feature: GYAE6OF02GSNJ3.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaggatcgtcctatcgttgacacaccaaactacgcacagaacttcagggcagactcaaccataaccgcggaacaaacttaacgaacacaagtaatacgtaggagctagaacagcctagtcatcagagacacgggtcttctacttctgtgcgtaggagttaattactaataacactcgtcttccttttactacccttcccttgtaccttcgtcgggtcctacgttaccggtaacccggttccaccgtcccg

SEQ ID NO: 104373 - DNA, 562 bp, Homo sapiens
  misc_feature: GYAE6OF02IF9V1.17.34.D01.1.454.CMB.1.raw
  modified_base (385)..(385): a, c, t, g, unknown or other
  misc_feature (385)..(385): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataacccgnggaacaaaattaacgaacacaagttaaatactaggagctagaacagacctgtcatctagaggacacgggcttctacttctgtgcgagtagtaattactaataacactagcttcctttttacaccttcccttgtacttcgtcgggtcctacgtcggtaaccccggtccgacccgtccc

SEQ ID NO: 104374 - DNA, 535 bp, Homo sapiens
  misc_feature: GYAE6OF02FKRFT.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaatttgggtgcgacgggcctctggacaaggccttgagtggatgggaaggatcgtccctatcgttgacacaccaaactacgcacagaagttccagggcagactcaccataaccgcggacaaataacgaacacagtaatctaggagctagaacagcctgtacatctgagacacgggtcttactacttactgtgcgagagtaatactatacactgcttccttttacaccttccttgtacttcgtcggtcactcggtacccgtcg

SEQ ID NO: 104375 - DNA, 550 bp, Homo sapiens
  misc_feature: GYAE6OF02H2I19.17.34.D01.1.454.CMB.1.raw
  modified_base (317)..(317): a, c, t, g, unknown or other
  misc_feature (317)..(317): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcacttcagcgactatagtttcaattgggtgcgacgggctctggacaaggccttgagtggatgggaagntcgtcctatcgttgacacaccaaactacgcaacagaagttccagggcagactacacaataaccgcggaacaaattaacgaacaacagttaatactaggagactagaacacgctgtacatactgacgacacgggcttctacttctgtcgcgaggtataattactaataacactgtacttccttttacacccttcctgtacttcgtcggcctagtaccggacccgtcaccgtccc

SEQ ID NO: 104376 - DNA, 540 bp, Homo sapiens
  misc_feature: GYAE6OF02F5RIW.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggaacaaattaacgaacacagttaatctggagctagaacagcctgtcatctgaggacacgggcttctacttctgtgcgaggagtaatactatacactgcttccttttacaccttcccttgtacttcgtgggcctacgtacggaccccgtcccg

SEQ ID NO: 104377 - DNA, 597 bp, Homo sapiens
  misc_feature: GYAE6OF02GLMDE.17.34.D01.1.454.CMB.1.raw
  modified_base (465)..(465): a, c, t, g, unknown or other
  misc_feature (465)..(465): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggaacccttggtcttccggcgagcgggcttttcacccgtctttatcgttacttatgtcagcatttcgcacttctgatacctcagcatcgcctcacagcacaccttcacaggcttacagaacnctcccctaaccaacaacgcaactaacgcgtaccgctcgccgcagtccttcggtcgctacgttcggtttaaccgtcccccgttttacactttcccgttccccgacctacttcctgtaaccttacgtccgtacg

SEQ ID NO: 104378 - DNA, 572 bp, Homo sapiens
  misc_feature: GYAE6OF02GQB6F.17.34.D01.1.454.CMB.1.raw
  modified_base (423)..(423): a, c, t, g, unknown or other
  misc_feature (423)..(423): n is a, c, g, or t
  modified_base (517)..(517): a, c, t, g, unknown or other
  misc_feature (517)..(517): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagatcgtcctatcgtgacacaccaaactacgcacagtaacgtccgaggcagactcacactaaccgcgaactaaactaacgaacactaagttaatacgtagganactagaacacgcctagctatcgagacgacgacggtcttactacttcgtgtagcgaggtattaattactaatactactacgtcttaccttttacncccttaccttacgtaccgttcgtcgggtacctacggttaccggaccccgttaccg

SEQ ID NO: 104379 - DNA, 580 bp, Homo sapiens
  misc_feature: GYAE6OF02FFND8.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgctgggtcctcgggtgagggtctcctgcaaggcttcgtggacggcaccttcagcgactatagtttcaagtttgggtgcgacgggcctctgacaaggccttgagtggatgggaggatcgtcctatcgtgacacaccaaactacgcacagaacgttcagggcagactcaccataaccgcgaacaaactaacgaacacagttaatctaggacgtactacgaacacgtcctgtactatcgtagacggaccgtacgggtcttactacttgtcgtagcggaagtagttaattaactagtaacactacgtccttaccttttaccctaccttacccttagtaccttcgtacgggtactacgtaccggaccccgttcccg

SEQ ID NO: 104380 - DNA, 554 bp, Homo sapiens
  misc_feature: GYAE6OF02HOR6N.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcgacaaataacgaacacagttaatctaggagctagaacagcctgtacatctgaggacgacgggcttctacttctgtgcgaggtagtaattactatacactacgtcttaccttttacacccttcccgttgtacctttcgtcgggtacctacgttccggaaccccgtccg

SEQ ID NO: 104381 - DNA, 548 bp, Homo sapiens
  misc_feature: GYAE6OF02I8MDD.17.34.D01.1.454.CMB.1.raw
  modified_base (422)..(422): a, c, t, g, unknown or other
  misc_feature (422)..(422): n is a, c, g, or t
  modified_base (466)..(466): a, c, t, g, unknown or other
  misc_feature (466)..(466): n is a, c, g, or t
  modified_base (490)..(490): a, c, t, g, unknown or other
  misc_feature (490)..(490): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgaggtggatgggaaggatcgtccctatcgttgacacaccaaactacgcacagaagttccagggcagactcacataaccgcggaacaaattaacgaaacacaagttaatctagganctacgaacagcctagtcatctagaggacgacggcttactacttntgtgcgtaaggagtaattacatanactgtcttacctttacaccttcccttgaccttcgtcgggtccagtcggtacccgtacc

SEQ ID NO: 104382 - DNA, 556 bp, Homo sapiens
  misc_feature: GYAE6OF02HCK64.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcctatcgttgacacgaccaaactacgcacagaagttccagggcagactcaccataaccgcggaacaaattaacgaacacaagttaatctaggagctagaacagaccttgtacatcagaggacacgggcttctacttctgtgcgaggataattactatactatcgtcttaccttttactacccttcccttagtacctttcgtcgggtacctacgttccggaccccgtccg

SEQ ID NO: 104383 - DNA, 549 bp, Homo sapiens
  misc_feature: GYAE6OF02GJ48L.17.34.D01.1.454.CMB.1.raw
  modified_base (259)..(259): a, c, t, g, unknown or other
  misc_feature (259)..(259): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagttcaattgggtgcgacgggcctctggacaaggccttgagtggatgggaaggatcgtccctatcgttgacacaccaaactacgcacagaagttccaggcagactcaccataaccgcgaacaaataacgaacacagttaatctaggagctagaacagcctgtcatctgaggacacggtcttctacttctgtgcgagagtaattactatacactgtcttaccttttactacccttcccgttacgtacttccgtcgggtcctacgtaccggaccccggtaccg

SEQ ID NO: 104384 - DNA, 555 bp, Homo sapiens
  misc_feature: GYAE6OF02GDBA1.17.34.D01.1.454.CMB.1.raw
  modified_base (409)..(409): a, c, t, g, unknown or other
  misc_feature (409)..(409): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggatcgtccctatcgttgacacaccaaactacgcacagaagttccagggcagactcaccataaccgcgacaaataacgacacagtaanctgagctagaacagcctgtcatctgaggacacgggcttactacttctgtgcgaggagttaagttactatacactagtccttacctttttacctaccctttacccttgtacctttcgtcgggtcctacgtaccggtacccggtaccc

SEQ ID NO: 104385 - DNA, 548 bp, Homo sapiens
  misc_feature: GYAE6OF02JA9UE.17.34.D01.1.454.CMB.1.raw
  modified_base (259)..(259): a, c, t, g, unknown or other
  misc_feature (259)..(259): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatgtttcaattggggtgcgacgggcctctggacaaggccttgagtggatgggaaggatcgtccctatcgttgacacaccaaactcgcacagaattccgaggcagactcaccataaccgngacaaataacaanacatatctgagntgacagcngtcntcnagacgaggcttctacttctgtgcgaggtagtaagttactatacactcgtcctttaccctttttacctacccttccctttcgtacctttcgtcgggtcctacggtccggtaaccccggtacccg

SEQ ID NO: 104386 - DNA, 572 bp, Homo sapiens
  misc_feature: GYAE6OF02GWU2U.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaccaaactacgcacagaagttcaggcagactcacataaccgcgaacaataacgaacacagttaatctaggagctagaacagcctgtcatctagacggacgacgggtcttacctacttcgtgtcgcggtaaggtagttaaattactaataactacgtacgtcctttccttttaaccaccctttaccctttgtacctttccgtcgggtacctaggtaccggaccccggttaccg

SEQ ID NO: 104387 - DNA, 542 bp, Homo sapiens
  misc_feature: GYAE6OF02FZU5O.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaataacgaacacagttaatctgagctagaacagcctagtcatctgaggacacgggcttactacttctgtgcgaggagtaattactatacactagtctcctttttacacccttccttagtacttcgtcgggcctactcggaccccgtaccg

SEQ ID NO: 104388 - DNA, 589 bp, Homo sapiens
  misc_feature: GYAE6OF02H1UTT.17.34.D01.1.454.CMB.1.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggacccttggtcttccggcgagcgggcttttcacccgctttatcgtttacttatgtcagctattcgcacttctgatacctccagcatcgcctcacagcacaccttcacaggcttacagaaccgcctcccctaaccaaccaacgcaataacgccgtcgctcgcccgcacgtccttcggtcgctagttcggtttaccgccccgttaacacttcccttcccgcctacttcctacgtacctagtaccg

SEQ ID NO: 104389 - DNA, 562 bp, Homo sapiens
  misc_feature: GYAE6OF02HBZFP.17.34.D01.1.454.CMB.1.raw
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttagtgcaatctggggctgaggtgaagacgcctgggtcctcggtgagggtctcctgcaaggcttcnggaggcaccttcagcgactatagtttcaaattggggtgcgacgggcctctggacaagggccttgagtggatgggaaggntcgtccctatcgttgactacaccaaactacgcacagagttccagggcagactcaccataaccgcggacaaattaacgaacacagttaatctaggagctagaacagcctgtacatctgacggacacgggcttactacttctgtgcgagtacgtaattactatacactgtcttaccttttacaccttcccttagtacctttccgtcgggtaccctacgttaccggtaaccccggtccg

SEQ ID NO: 104390 - DNA, 661 bp, Homo sapiens
  misc_feature: GYAE6OF02GDEP4.17.34.D01.1.454.CMB.1.raw
  modified_base (198)..(198): a, c, t, g, unknown or other
  misc_feature (198)..(198): n is a, c, g, or t
tcagcgtagactagcacgaccggtgctcgatttagatcgtctgtgttggggttttggggggtacgatttgatgttacctgatgcgttagaggcttttcctggaagccagggcatttgttgcttcacgccacccgtacgtgccctcgtcatcacggccctcgacgccttgattttcccggatttgccctggaaaacccngccctacccgcttaaaccgggacaaccgtccgcccggccaacatacgccttctccgtccccccttcgcagtaacaccaagtacaggaatataacctgttccatcgactacgcctttcggcctcgcctagggtcactccaccctgaccccattaacgtgacaggtaacccttggtcttccggcgaagcgggtccttttccaccgtcgtttactcgttactatgtcagtcatttccgactacttctacgaactaccctcccacgccagttcgtcccgtcgacctacgccacctacctttacacgtacggaccttacaacgtaaccgtccctaccccctaacccaaaccaaccgtccaataacgcgtcgccgtcgacccgacacgtcttcggtgtcgtacgtcggtttaccgccccgttttacaccgttccttcccgctactcccgtacgaccttacgtcctaccg

SEQ ID NO: 104391 - DNA, 552 bp, Homo sapiens
  misc_feature: GYAE6OF02HUYCG.17.34.D01.1.454.CMB.1.raw
  modified_base (382)..(382): a, c, t, g, unknown or other
  misc_feature (382)..(382): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaaggccttgagtggatgggaaggatcgtccctatcgttgacacaccaactacgcacagaagttccaggcagactcacataaccgngacaaatacgaacacagtatctagagctagaacagcctgtcatctgaggacacgggcttcttacttctgtgacgaggtattaattactaataacactgtccttaccttttaactacccttcccttcgtaccttcgtcgggccacgtccggtaaccccgtctacccgtccc

SEQ ID NO: 104392 - DNA, 553 bp, Homo sapiens
  misc_feature: GYAE6OF02HFA4F.17.34.D01.1.454.CMB.1.raw
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtcctatcgttgacacacaaactacgcacagaagttcaggcagactcacataaccgngacaaataacgaacacataatntaggagctagaacagcctgtacatctcgaggacgacggtcttctacttctgtgcgagtataatactataacactgtacttccttttaacacccttcccttcgtaccttcgtcgggtcctacgtacggtaaccccggttccgtacccgttccc

SEQ ID NO: 104393 - DNA, 846 bp, Homo sapiens
  misc_feature: GYAE6OF02JM46W.17.34.D01.1.454.CMB.1.raw
  modified_base (283)..(283): a, c, t, g, unknown or other
  misc_feature (283)..(283): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaatttgggnttcggacgtccggtacgtcgtacgtacggacgtcgtcgtaggtaggtagggaaggtaggtacgtccgttaccgttacgttacgtacgtaacaaccaaaccgtaaccgtaacgaccgaacgtaacgtaacggtaaccggtacggaacggtacgtaaccgtaccctaacccgaaacccgtaaccgggaaccgtaaacgtaaaaccgtaaaaccgtaaaccgtaaacgttaaacgttaacgttaacggtaacggtacgtaacgtaacgtaaccgtaaccgtaccgtaaccgttacgtaccgtacgtacggtaacggtaaccggtaccggttaccgtttaccgtttaccgtttacgttacggttaccgggtaacggtaacggttaaacggtttaaaccgtttaacgttaacccgtaaccgttaaccgttaacccggtttaaccctttttaaccccttttaacccgtttaaccccgtttaacccgtttacccggtttaccggttaaccccgggtttacccgggtaaccccggttaaccccgggttaaccccggtttaacccccccggg

SEQ ID NO: 104394 - DNA, 526 bp, Homo sapiens
  misc_feature: GYAE6OF02JUFZ1.17.34.D01.1.454.CMB.1.raw
  modified_base (245)..(245): a, c, t, g, unknown or other
  misc_feature (245)..(245): n is a, c, g, or t
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcnggagcaccttcagcgactatagttcaagttgggtgcgacgggcctcgtggacaaggtccttggagtggatgggaagatcgtcctatcgtgacacacaaactcgcacagacgttcaggcagctcacataaccgngaacaataacgacactatanctaganactagacagctgcatcngacgacncggacttcgacttgngtgacgagtagttaatacatacactgtcttaccgttacaccttctagtcttcgtcggcctacgtccggtacccgtctaccgtc

SEQ ID NO: 104395 - DNA, 551 bp, Homo sapiens
  misc_feature: GYAE6OF02HMEGP.17.34.D01.1.454.CMB.1.raw
  modified_base (475)..(475): a, c, t, g, unknown or other
  misc_feature (475)..(475): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggagtgggaaggatcgtcctatcgttgacacaccaaatacgcacagaattccaggcagactcaaccataaccgcggaacaaattaacgaaactaacaagttaactcgtaggagactagaacagaccttgtcatctagaggacacggcttactacttctgtcgngagagtaattactatacactgtcttcctttacaccttcccttgtacttcgtcggtaccacgtccggacccgtaccg

SEQ ID NO: 104396 - DNA, 559 bp, Homo sapiens
  misc_feature: GYAE6OF02GU9N6.17.34.D01.1.454.CMB.1.raw
  modified_base (420)..(420): a, c, t, g, unknown or other
  misc_feature (420)..(420): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaaattgggtgcgacgggcctctggacaaggccttgagtgggatgggaaggatcgtccctatcgttgacacaccaaactacgcacagaagttccagggcagactcaccataaccgcgaacaaataacgaacacaataatctagganctagaacagctgtcatctgagacgacggtcttctactctgtgcgagtagtaattactaatactactacgtccttaccttttaccacccttcccgttacgtacttcgttcgggtccctacgtaccggtacccggtacccg

SEQ ID NO: 104397 - DNA, 561 bp, Homo sapiens
  misc_feature: GYAE6OF02IS62E.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggacagactcaccataccgcggaacaaattaacgaacacagtaatctggagctagaacagcctgtcatctgaggacgacggtcttctacttctgtgcgaggagtaacttactataacactgtcttaccttttacaccttcccttagtaccgttacgtcgggtcctacgtccggtaaccccggtccgtacccgtcccg

SEQ ID NO: 104398 - DNA, 568 bp, Homo sapiens
  misc_feature: GYAE6OF02JD2F0.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataacccgcggaacaaattaacgaacacaagttaatctaggagctagaacagcctgtacatctgacggacacgggtcttctacttctgtgcgagtagtaacttactaataacactgtcttaccttttacctacccttcccttgtacctttcgtcgggtacctacgtccggaaccccggttcctacccgttccc

SEQ ID NO: 104399 - DNA, 809 bp, Homo sapiens
  misc_feature: GYAE6OF02J3OLY.17.34.D01.1.454.CMB.1.raw
  modified_base (581)..(581): a, c, t, g, unknown or other
  misc_feature (581)..(581): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacaggtgtccagtcccaggtccagttggtgcaatcgtggggctggaggtgaagacgccgtgggtcctacgggtgacgggtctccgtgcgaaggtccttcgtgggacggtcctaaccgttcgacgtcggtaaccttagttacggtttaccgaaggtttcgggggttgcccgggtaaccggggtccctacggttacgggaaccgtaacgggtccctttagggaaggttagggaggttacgggggtaacggtacgttcccggttacccgtaagtttccggttacgaaccccgtaaccaaacccgtaaaaccgtaccggactaacggaacggttaacgttcccggaagggtaccaacggtacctaccgaacccgtaacgttaacccggacggtaaactaaacgtaaccgaactaccgtaagttaacncgtaggactacgtacgaacctacgtcgttacgtacgtaccgttacgtacgggacgtaaccggttaccggttacctttaccgttacgttcgtaagggtacggacgtaagggttaacttaacttactaacgtactacgtttacgttcccgtttacctttaacccgaccctttccgttaggttacccgtttcgggccggttaactaccggttaccggtaccccgttacccg

SEQ ID NO: 104400 - DNA, 649 bp, Homo sapiens
  misc_feature: GYAE6OF02IGNNL.17.34.D01.1.454.CMB.1.raw
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcacttcagcgactatagttcaattgggtgcgacgggcctcgtggacaaggccttgagtggagtgggaagatcgtcctatcgttgactacaccaaactacgcacagaagtccagggcagactcacaataaccgcggaacaaattaacgaacacagttaanctagganacgtagaacagcctagtacatcgtagacggacgacgggtccttacgtaaccttcgtacgtcgacggtaacggtaagttaaaactttacttaaactaaaccgtacgtacgttaccgttttaccctttttaaccgaacccctttaccccgtttaagttacccgtttaccgggttaccggggtacccttaacggttacccggggtaaccccccggttaccgtaccccggtttaccccg

SEQ ID NO: 104401 - DNA, 541 bp, Homo sapiens
  misc_feature: GYAE6OF02FXSNI.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcctatcgttgacacaccaaactacgcacagaagttccagggcagactcaccataaccgcgaacaaataacgaacacagttaatctaggagactagaacagcctgtcatctgaggacacgggcttactacttctgtgcgagagtaattactatacactagtcttccttttacaccttaccttcgtacttcgtcggtcgactacgacccgtacccg

SEQ ID NO: 104402 - DNA, 553 bp, Homo sapiens
  misc_feature: GYAE6OF02INN3M.17.34.D01.1.454.CMB.1.raw
  modified_base (326)..(326): a, c, t, g, unknown or other
  misc_feature (326)..(326): n is a, c, g, or t
  modified_base (436)..(436): a, c, t, g, unknown or other
  misc_feature (436)..(436): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtcctccgtgcaaggcttcgtggaggcaccttcagcgactatagtttcaattgggtgcgacgggcctctggacaaggccttgagtggatgggaaggntcgtcctatcgttgacacaccaaactacgcacagaacgttccgaggcagactcaccataaccgcgaacaaatacgaacacattaatctgagctagaacagcctgtcatcngacgcacggtcttctacttctgtgcgagataatactatacactcgtctttaccttttacacccttacccgttagtaccgtttcgtcgggaccctagtaccgggtacccccgttaccg

SEQ ID NO: 104403 - DNA, 616 bp, Homo sapiens
  misc_feature: GYAE6OF02H3PJD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttccttctttggtggtggcagcagctacaggtgtccagtcccaggtccagttggtgcaatcgtgggctgaggtgaagacgccgtgggtcctcggtggagggtcctccgtgcgaaggcttcgtgggaggccaccttcgaggccgacttattagtttcaagttggggtgccggacgggtccttcgtggacaacgggtccttggacggttggacgtggggaaggacttcgtaccctagtcgttgacaccaaccaaactacgcacgagaactcgaggcagctacaccataacgcgaactaaactaacgaacacgaagttaatcgtaggacgactagaacgagtacctagtacactctgacggtacgacgggtccttacgtactcgtgtgacgagtaagttacttatatacacgtacgtctttaccttttacgacccttccttcgtaccgttcggtcggtaccgtacgtaccggtaccccggtacccg

SEQ ID NO: 104404 - DNA, 604 bp, Homo sapiens
  misc_feature: GYAE6OF02IP0US.17.34.D01.1.454.CMB.1.raw
  modified_base (322)..(322): a, c, t, g, unknown or other
  misc_feature (322)..(322): n is a, c, g, or t
  modified_base (416)..(416): a, c, t, g, unknown or other
  misc_feature (416)..(416): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagttcaagttggtgcgacgggcctctggacaaggccttggagtggagtgggaagngtcgtcctagtcgtgacacaccaactacgcacagagttccaggcagactcaccataaccgcgaacaaataacgaacacaagttaatctaggacnctagaacacgcctagtcactctagacgacgacggtcttacttacttctaggtcgacgtaggtaagttaaacttactaatacgtacgttacgtaccctttacccgtttttacctaccccgttaccctttacgttaccgtttaccggttccgggtaccctaacggttacccggtaacccccggttacccg

SEQ ID NO: 104405 - DNA, 556 bp, Homo sapiens
  misc_feature: GYAE6OF02GVN0T.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctagagctagaacagcctgtcatctgaggacacgggcttctacttctgtgcgaggagtaattactatacactgtcttcctttttaaccacccttcccttgtacctttcgtcggggtacctacgttaccggacccccggttaccg

SEQ ID NO: 104406 - DNA, 582 bp, Homo sapiens
  misc_feature: GYAE6OF02IQEOE.17.34.D01.1.454.CMB.1.raw
  modified_base (444)..(444): a, c, t, g, unknown or other
  misc_feature (444)..(444): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggcttctggaggcaccttcagcgactatagtttcaattgggtgcgacgggcctcgtggacaaggccttgagtggatgggaaggatcgtaccctagtcgttgacacaccgaaactacgcacacgaagttccgagggcagtactccaacactaaccgcggaactaaattaacgaaacacgtaagtaaactctaggacgctacgaacngcctagtcatcgtagagaccgacggtcttacgtacttcgtgtacgcgaggtaagtaattaactatacacttgcctttaccttttacgtacccttcctttacttccgtcgggcctagtccggttaccccggctacccgg

SEQ ID NO: 104407 - DNA, 561 bp, Homo sapiens
  misc_feature: GYAE6OF02HCOI9.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagccgactatagtttcaattgggtgcgacgggcctctggacaaggccttgagtggatgggaagntcgtcctatcgttgacacaccaaactacgcacagaagttccaggcagactcaccataacccgcggacaaataacgaacacagttaatctaggagactagaacacgcccgtcactctgaggacacggcttctacttctgtgcgaggagtaattactataactactagtccttccttttacctacccttccctttacgtacctttcgtcgggtcctacgtaccggtaccccgtctacccg

SEQ ID NO: 104408 - DNA, 565 bp, Homo sapiens
  misc_feature: GYAE6OF02F8M0B.17.34.D01.1.454.CMB.1.raw
  modified_base (321)..(321): a, c, t, g, unknown or other
  misc_feature (321)..(321): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgaggggtctcctgcaaggcttctggaggcaccttcagcgactatagtttcaattgggtgcgacgggcctctggacaaggccttgagtggatgggaagntcgtcctatcgtgacacaccaactacgcacagaagttccagggcagactcaccataaccgcggaacaaattaacgaacaacaagttaactctaggagctagaacagacctgtacatctgaggacacgggtcttctacttctgtgcgaggtagtaattactaataacactgtacttaccttttaacacccttcccttacgtacctttcgtcgggtcctagtaccggaccccgtccacccgttccc

SEQ ID NO: 104409 - DNA, 563 bp, Homo sapiens
  misc_feature: GYAE6OF02JPPHP.17.34.D01.1.454.CMB.1.raw
  modified_base (324)..(324): a, c, t, g, unknown or other
  misc_feature (324)..(324): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagttcaagttgggtagcgacgggcctcgtggacaggccttgagtggatgggaagntcgtcctatcgtgacacacaactcgcacagacgtcagggcagctcacanaccgngacaaataacaacacagtaancgtagagacagaacacgactgtacatctagagacgacggacttaccgtacttcgtgtagtcgaagtacgtaattactaatactacttcgtaccttacttttaccgtacccttcccttacgtacgtttacgtcgggtacctacggttaccggaccccgttacccg

SEQ ID NO: 104410 - DNA, 628 bp, Homo sapiens
  misc_feature: GYAE6OF02IUFYK.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacggcctctggacaaggccttgagtggatgggaagatcgtcctagtcgttgacacaccaaactacgcacagaagttccgaggcagactacacataaccgcgaacaataacgaacacaagttaatcgtaggacactagaacagccttagtactatacgtagacggacgacgggtacttactacctttcgtcggttcgacgtaaggtaacgttaaacgtttaaccgttagtaaaccgtaccgttacggtacccttttaccgtttttaacccgtaacccttcccgtttacgtacctttaccggtacggggtaccctaccggttaccgggtacccccggttacccg

SEQ ID NO: 104411 - DNA, 550 bp, Homo sapiens
  misc_feature: GYAE6OF02GK86D.17.34.D01.1.454.CMB.1.raw
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctctggacaaggccttgagtggatgggaagntcgtcctatcgttgacacaccaaactacgcacagaacgttccagggcagactcacanaaccgngaacaaataacgaacacaagttaatctagganctagaacagcctgtcatctgacgacacggtcttctactctgtcgacgtagagtaatactatacactagtccttactttaccaccttcccgttagtaccttcgtcgggtacctacgtacggaccccgtacccg

SEQ ID NO: 104412 - DNA, 552 bp, Homo sapiens
  misc_feature: GYAE6OF02GOYTD.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtccctatcgttgacacaccaaactacgcacagaagttccagggcagactcaccataaccgcggaacaaattaacgaacacaagttaatactaggagactgaacagcctgtcatctgaggacgacgggcttctacttctgtgcgaggagtaattactatacactgtcttaccttttaccacccttcccttcgtacttcgtcgggtcctagtaccggaaccccgtccg

SEQ ID NO: 104413 - DNA, 599 bp, Homo sapiens
  misc_feature: GYAE6OF02JPVOG.17.34.D01.1.454.CMB.1.raw
  modified_base (281)..(281): a, c, t, g, unknown or other
  misc_feature (281)..(281): n is a, c, g, or t
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttctggaggcaccttcagcgactatagtttcaattgggngcgacgggcctctgggacaaggccttgagtggatggggaagntcgtccagtcgttgacacaccaaatacgcaacagaagttccgaagggcaagactcaccaataccgagaacaaacttaacgaacaacagttaatcgtaggagctagaacacgacctagtacatcgtagacggacgacggtacttctaacttcgtgtcgtacggtagtaagtaattacgttaatacgtactcgtcctttacctttttacacccttacccgtttacgtaccgtttaccggtaccgggttacccacggttaccgggtaaccccgttaccg

SEQ ID NO: 104414 - DNA, 535 bp, Homo sapiens
  misc_feature: GYAE6OF02JCS71.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggggcctctggacaaggccttgagtggatgggaaggatcgtccctatcgttgacacaccaaactacgcacagaagttccagggcagactcaccataaccgcggacaaataacgaacacagttaatctggagctagaacagcctgtcatctgaggacacgggcttctactctgtgcgaggagtaattactatacactgcttccttttacacccttccttgtacttcgtgggcctatcggaccccgtccg

SEQ ID NO: 104415 - DNA, 824 bp, Homo sapiens
  misc_feature: GYAE6OF02F7VCD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcgcgcgactagttacgttactaaggtttgggtgccgggtaccggtccttcggtacggaacgtaacggtccgttaggagggtaggtaggtaggggaaggtacgtcccgttacccgtagtttcggttacgaaccaaccaaaccctaaacgttaccgacgtaacgaaggttaaccgtaccggacgggacaacgtacctaccaaccctaacggtaacccggaccgaaacttaaacgttaaaccgaaacaacgtaaacgttaactacggtaggacgtaccgtaagaaaccgtacgtccgttacgtactaacgttcgtacggtaaccggaaccggtaaccggggttcctttaaccgttaaccgttttccgttacgggttacggtaccgggtaaggttaaacgtttaaacgtttaaccgttaaacgtaaccttacggttaccgttacccctttttaaccctttttaaaccccgttaacccctttcccgtttaaccgtttacccggttttaccgggttacccgggtaacccgttaaccgggttacccccggggtaacccccggtttaaccccgg

SEQ ID NO: 104416 - DNA, 566 bp, Homo sapiens
  misc_feature: GYAE6OF02INPWG.17.34.D01.1.454.CMB.1.raw
  modified_base (324)..(324): a, c, t, g, unknown or other
  misc_feature (324)..(324): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
  modified_base (426)..(426): a, c, t, g, unknown or other
  misc_feature (426)..(426): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctggtgagggtctcctgcaaggcttctggagcaccttcagcgactatagtttcaattgggtgcgacgggcctcgtggacaaggccttggagtggatgggaaggntcgtcctatcgttgacacaccaaactacgcacagagttcagggcagactcacanaccgngacaaatacgaacacataatcngagctagaacagctgtcatcngacgacacgggtcttactacgttctggtcgacgtaggattaattacgtaataccgtacgtacgtcctttacccttttaacctacccttccctttagtacctttcggtaccgggtcctacgtaccgggtaaccccgtcccg

SEQ ID NO: 104417 - DNA, 553 bp, Homo sapiens
  misc_feature: GYAE6OF02INIKH.17.34.D01.1.454.CMB.1.raw
  modified_base (320)..(320): a, c, t, g, unknown or other
  misc_feature (320)..(320): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggcttctggaggcaccttcagcgactatagtttcaattgggtgcgacgggcctctggacaaggccttgagtggatggaagntcgtcctatcgttgacacaccaaatacgcacagaagttcaggcagactcaccataaccgcgacaaataacgaacacaagttaatctagagctagaacagcctgtacatctagaggacacggcttactacttctgtgacgagtagtaattactaatactactcgtacttaccttttactacccttcccgttagtactttccgtcgggtacctacgtacggtaccccggtacccg

SEQ ID NO: 104418 - DNA, 567 bp, Homo sapiens
  misc_feature: GYAE6OF02GFS0J.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcctatcgttgacacaccaaactcgcacagaagttccagggcagactcaccataaccgcgaacaaattaaccgaacacaagttaatactaggagactagaacagacctgtacatctgaggacgacggcttctacttctgtgcgaggtataattactataacactgtcttaccttttactaccttcccttcgtacctttcgtacgggtcctacgtaccggtaaccccggtccgtacccgttcccg

SEQ ID NO: 104419 - DNA, 558 bp, Homo sapiens
  misc_feature: GYAE6OF02GK59V.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaagatcgtcctatcgttgacacaccaaactacgcacagaagttccagggcagactcaccataaccgcggaacaaattaacgaacacaagttaatactaggagctagaacagcctgtacatctgaggacacggcttctacttctgtgcgaggtagttaattactaatacactgtcctttaccttttaccaccttcccttgtaccttcgtcgggcctagtccggtaccccgtcgtacccgtccg

SEQ ID NO: 104420 - DNA, 552 bp, Homo sapiens
  misc_feature: GYAE6OF02GUG2M.17.34.D01.1.454.CMB.1.raw
  modified_base (320)..(320): a, c, t, g, unknown or other
  misc_feature (320)..(320): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggctctggacaaggccttgagtggatgggagntcgtcctatcgtgacacacaactacgcacagacgtcaggcagactcaccataccgcgaacaataacgacacagtaatactgagctagaacagacctgtacactcgtagacggacgacggtcttacgtacttcgtagtgacgaggtactaattacgtatacacgtcgtctttaccttttacacccttacccttagtacttcggtcgggtacctacggtacggaccccgttccg

SEQ ID NO: 104421 - DNA, 613 bp, Homo sapiens
  misc_feature: GYAE6OF02GU0KT.17.34.D01.1.454.CMB.1.raw
  modified_base (327)..(327): a, c, t, g, unknown or other
  misc_feature (327)..(327): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttcggtgcaatctggggctgaggtgaagacgcctgggtcctcggtgagggtctcctgcaaggcttctggaggcaccttcagcgactatagtttcaagttgggtgcggacgggcctcgtggacaaggccttgagtggatgggaaggntcgtcctatgttgacacacaaactacgcacagaagttccagggcagactacacaataaccggcgaactaaacgttaacgaacaacgaagttaaactcgtaggagtctagaaacctacgaccgtgtactatactaggaacggacgacggtcttaccttacttcgtggttgcgtaggtaacgttaattactaatactactacgtccgtttacctttttacctacccttcccgtttacgtaccttttccggacgggttccctacggttacccggtaaccccggtacccg

SEQ ID NO: 104422 - DNA, 644 bp, Homo sapiens
  misc_feature: GYAE6OF02HN7HV.17.34.D01.1.454.CMB.1.raw
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
  modified_base (445)..(445): a, c, t, g, unknown or other
  misc_feature (445)..(445): n is a, c, g, or t
tcagcgtagactagcacgaccggtgctcgatttagatcgtctgtgttgggtttggggacgaaacaaccagattcctcctctaaagaagcccctgggagcacagctcatcaccatggactggacctggaggttcctctttgtggtggcagcagctacaggtgtccagtcccaggtccagttggtgacaatcgtggggctagaggtcgaagacgcctggggtccctggtagagggtctcctgcaaggcttctgggacggctaccttcagcgactatagtttacaagtgggtgcggacgggcctacgtggacaacggccttgagtggagtcgggaagngtccgcctagttcgtgacacaccaaactacgcaacagaacgtcaggganagactcgaccaactaacccggacgaactaaaacgtaacgaacactagtaatacgtggactntagaacagcctgtacaatctagacgacgtacgggtactaccttagttcccgtgtacgtaccgaagggttaattaaatacgtaaactaacttaccgagttaccgtttaccctttttaaccgcccttaccgttacgttaacccgttcggtaccgggtccgtaaccgttacgggtaacccccgttaccggacctttccccgg

SEQ ID NO: 104423 - DNA, 539 bp, Homo sapiens
  misc_feature: GYAE6OF02GH7UY.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaagntcgtcctatcgttgacacaccaaactcgcacagaagttccagggcagactcaccataaccgcggaacaattaacgaacacagttaatctagagctagaacagcctgcatctgagacacggcttctactctgtgcgagataattactatacactgtcttaccttttacacccttccttagtaccttcgtcgggtcctacgtaccggtacccgtcccg

SEQ ID NO: 104424 - DNA, 544 bp, Homo sapiens
  misc_feature: GYAE6OF02GE5EO.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagatcgtcctatcgttgacacacaaactacgcacagaagtccagggcagactcacatacgcgaacaaatacgaacacagtaatctgagctagaacagctcgtcatctgagacgacggtcttctactcgtgtcgcgaggtataattactatacactgtccttaccttttacctacccttacccttacgtacttcgttcgggcctacgtaccggtaccccgtaccg

SEQ ID NO: 104425 - DNA, 894 bp, Homo sapiens
  misc_feature: GYAE6OF02H68FL.17.34.D01.1.454.CMB.1.raw
tcagcgtagactagcacgaccggtgctcgatttagatcgtctgtgttgggtttgggatcaccaaaacaacccagattcctaccgtctaaagtaacgccccttgggagcacagctcatcacatggactggacctgaggttctcgtttgtggtggctaggtctagtctacaggtgtccgagtcccaggttcctagttggtgcaatcgtggggctggagggtgaagtacgccgtgggtcctcggtagacggttctctgcaaggcttctggagccacttcagccgactattagtttcctaagttgggtcggcgacgggcctcgttacggacgaaacgggtcctttggaacggttgggacgttgggggtaaacggaagtttccggttccccgttaagtttccggttttacggaaccgtaaccgtaaacccgtaaaacggtttaccggcccgtaaaccgttaacggtaaaaccggtttcccgaaacggggtcctaaggtaccgtaaccgtaaccctaagttaaaccccggcgggtaaacctaaaacgtttaaaccgaaaaccgaacgtaaacgtttaaacgtaccgttaacggaaccgtaccgtaacgtaaaccacgttacccgtacgttaaccgaacgttaccggttaacggaaccggtaaccgggtaaccggggttaccgtttaaccggtttacccgtttaccgtacgggttaacggtaaccggttaaaggttaaacgtttaaaagttttaaccgttaaacttaacccgtaacgttaaccggttacctttttaacccgtttttaaccctaacccgtttaaccccgtttacgtttacccgttttccgggttacggggtaccccttaacgggttaccccgggtaaccccggttaccccgg

SEQ ID NO: 104426 - DNA, 582 bp, Homo sapiens
  misc_feature: GYAE6OF02IDDY4.17.34.D01.1.454.CMB.1.raw
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
tcagcgtagactagcacgaccggtgctcgatttagatcgtctgtgttggggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggggaaggatcgtccctatcgttgacacaccaaactacgcacagaagttccagggcagactcaccataaccgcggaacaaattaacgaacacagttaatctagganctagaacagcctgtcatcngaggacacgggcttctacttctgtgcgaggagttaaattactaataactactgtacctttccgtttttaaccaccctttcccgttacgtacctttcgttcggggtaccctacgttccggaacccccggttcctacccggttccc

SEQ ID NO: 104427 - DNA, 557 bp, Homo sapiens
  misc_feature: GYAE6OF02JLYRL.17.34.D01.1.454.CMB.1.raw
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (449)..(449): a, c, t, g, unknown or other
  misc_feature (449)..(449): n is a, c, g, or t
  modified_base (471)..(471): a, c, t, g, unknown or other
  misc_feature (471)..(471): n is a, c, g, or t
  modified_base (492)..(492): a, c, t, g, unknown or other
  misc_feature (492)..(492): n is a, c, g, or t
  modified_base (548)..(548): a, c, t, g, unknown or other
  misc_feature (548)..(548): n is a, c, g, or t
tcagcgtagactagcacgaccggtgctcgatttagatcgtctgtgttgggtttgggggtacgaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtncggacgggcctctggacaaggccttggacgtggagtgggaaggatcggtccctatcgttgacacaccaaactacgcaccagaacgttcgaggcagacgtcaccataacccgcggaacaaactaacgaacacagttaatcgtaggacgactgaacagcctgtacatcngacggacacgggcttcacttcngtcgcgaggaattaatactanactactgtctcctttacaccttccttgtcttcgtcggctacgtacggtaccccgtnacccgttcc

SEQ ID NO: 104428 - DNA, 589 bp, Homo sapiens
  misc_feature: GYAE6OF02IE57S.17.34.D01.1.454.CMB.1.raw
  modified_base (327)..(327): a, c, t, g, unknown or other
  misc_feature (327)..(327): n is a, c, g, or t
  modified_base (371)..(371): a, c, t, g, unknown or other
  misc_feature (371)..(371): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgcctgggtcctcgggtgagggtctccgtgcaaggcttcgtgggacggccaccttcgagcgactatagtttcaagttgggtgcgacggcctctggacaaggtccttgagtggagtgggaagntcgtcctatcgtgacacaccaatcgcacagtagtcaggcagacncacataaccgcgactaaatacgaacactactaatcgtagagtactagaacacgctgtacatcagacgactacggcttctacgtctgtacgacgtagtaacgttaacgttactaataactactcgtacctttacccgtttactacccttccgttcgtaccgtttccggtacgggtaccctaacgttacccgggtaaccccgttccgtacccgttacccg

SEQ ID NO: 104429 - DNA, 553 bp, Homo sapiens
  misc_feature: GYAE6OF02JCD84.17.34.D01.1.454.CMB.1.raw
  modified_base (384)..(384): a, c, t, g, unknown or other
  misc_feature (384)..(384): n is a, c, g, or t
  modified_base (413)..(413): a, c, t, g, unknown or other
  misc_feature (413)..(413): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagatcgtcctatcgttgacacaccaaactcgcacagaagttcagggcagactcaccataaccgngaacaaataacgaacacagtatactgganctagaacagcctagtcatctgagacgacggtcttctacttctgtgcgaggtagtaattactatacactgtccttaccttttacacccttcctttacgtacctttccgtacgggtcctacgttaccggtaccccgtacccg

SEQ ID NO: 104430 - DNA, 557 bp, Homo sapiens
  misc_feature: GYAE6OF02IG824.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatggggaaggatcgtcctatcgttgacacaccaaactacgcacagaacgttcagggcagactcaccataaccgcggaacaaataacgaacacagttaatctaggagctagaacagacctgtacatctagacggacacggcttctacttctgtgcgaggagtaattactatacactgtcttaccttttacacccttcccttacgtacctttcgtcgggtacctacgttccggaccccggtcccg

SEQ ID NO: 104431 - DNA, 619 bp, Homo sapiens
  misc_feature: GYAE6OF02I3S04.17.34.D01.1.454.CMB.1.raw
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (408)..(408): a, c, t, g, unknown or other
  misc_feature (408)..(408): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggattcgtggaggcaccttcagcgactatagtttcaattgggtgcgacgggcctntggacaaggccttggagttggatgggaagntcgtcctatcgtnacacaccaactacgcacgagaacgttccgaggcagactcacataaccgcgacaaactacgaacacagttaacncgtaggacgctagacacgcctagtacagtacgtaggacggaccgtaccgggtcttacttacgttcgtagtcgacggtaaggtaagtttaaacgtacttaaattaacgtacttacgtaccttttaccgttttaccctaccctttaccgttacgttaccttcggtacgggtacccttaggtacccgggtaccccgttacgtacccgttacccg

SEQ ID NO: 104432 - DNA, 555 bp, Homo sapiens
  misc_feature: GYAE6OF02GFWYV.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttggagtggatgggaagntcgtcctatcgttgacacacaactcgcacagagtcaggcagactcaccataaccgcgaacaataacgaacactaagttaatctggagctagaaccagcctgtacatctagacggacgacggtcttcctacgttctgtcgcgtaggagttaagttactatacactcgtccttaccttttacctacccttacccttagtaccttcgtcgggtcctacgtccggtaccccgtaccg

SEQ ID NO: 104433 - DNA, 554 bp, Homo sapiens
  misc_feature: GYAE6OF02HLGGQ.17.34.D01.1.454.CMB.1.raw
  modified_base (320)..(320): a, c, t, g, unknown or other
  misc_feature (320)..(320): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtcctatcgttgacacaccaaactacgcacagaagttccaggcagactcaccataaccgcggaacaaattaacgaacacagttaatctaggagctagaacagcctgtcatcgtgaggacacgggtcttctacttctgtgcgaggtagtaattactaatacactgacttaccttttacaccttccttcgtacttcgtcgggtcctacgtaccggaaccccggtcacccgtccc

SEQ ID NO: 104434 - DNA, 550 bp, Homo sapiens
  misc_feature: GYAE6OF02H29VU.17.34.D01.1.454.CMB.1.raw
  modified_base (323)..(323): a, c, t, g, unknown or other
  misc_feature (323)..(323): n is a, c, g, or t
  modified_base (419)..(419): a, c, t, g, unknown or other
  misc_feature (419)..(419): n is a, c, g, or t
  modified_base (488)..(488): a, c, t, g, unknown or other
  misc_feature (488)..(488): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggggtctcctgcaaggcttctggaggcaccttcagcgactatagtttcaattgggtgcgacgggcctctggacaaggccttgagtggatgggaagntcgtcctatcgttgacacaccaaactacgcacagaagttccagggcagactcaccataaccgcggaacaaattaacgaacacagttaatctagganctagaacagacctgtacatctagaggacacgggtcttctacttctgtcgcgaggagtaattactatacnctgctttccttttactaccttcccttagtacttcgtcggtcctacgtcggtaccccgtaccg

SEQ ID NO: 104435 - DNA, 556 bp, Homo sapiens
  misc_feature: GYAE6OF02F0ULM.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggntcgtccctatcgttgacacaccaaactacgcacagaagttccagggcagactcaccataaccgcgaacaaataacgaacacagttaatctaggagctagaacagcctgtcactctagacggacgacgggtcttacgtacttctgtgcgaggagtaattactaatacactgtcttaccttttaccacccttcccgttagtaccttcgtcgggacctacgtcggaccccgtccg

SEQ ID NO: 104436 - DNA, 671 bp, Homo sapiens
  misc_feature: GYAE6OF02F6O4T.17.34.D01.1.454.CMB.1.raw
tcagcgtagactagcacgaccggtgctcgatttagatcgtctgtggttgggtttgggggatcacaaaacgaaccagattccctccctctaaaggaagtcccccgtccgggagccacctacgctccactccacccaatgggacctggaccgtggaggttcctcctttgtcggtggcagcagctaacaggtcgtccaggtcccaggtccacgttcggtggcaactcgtggggactgaggtgaagacgcctgggtcctcggtgaggggtctacctgcaaggccttcgtggaggcaccttcagcgactatagtttcaagttgggtgcggacgggtcctcgtggacaaggccttaggagtggagtgggaaggagtcgtcctatcgttgacgacgaccgaaactacgacacagtaacgttccgagggcagactcgaccaggtaacccgcggaacaaacgttaaccgaaacctacaagttaactacgtaggacgtctaggaaccacgtccgttagtactagtcgtagaggaccgtacgggtctttacgtacgtttcgtggtcggcgaggtacgttaagttacgtattacgtacgttcggtccgttaccgttttaccgacccttccgttacgtaccgttccggtcgggtacccacggttacccggaaccccggttcccg

SEQ ID NO: 104437 - DNA, 573 bp, Homo sapiens
  misc_feature: GYAE6OF02JLMI9.17.34.D01.1.454.CMB.1.raw
  modified_base (325)..(325): a, c, t, g, unknown or other
  misc_feature (325)..(325): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgagggcctcgtggacaagggccttgaggtggatgggaaggntcgtcctatcgtgacacacaactcgcacagaacgttccagggcagactcacatacccgnggaacaataacgaacacagttaanctagagctagaacagcctgtacatctgagaccgacggcttcctacttctgtcgcgaggagttaatatactactactcgtccttacctttttacctaaccctttcccgttacgttacccgtttcgtaccggggtcctaacggttaccgggtaacccccggtacccg

SEQ ID NO: 104438 - DNA, 615 bp, Homo sapiens
  misc_feature: GYAE6OF02JEJV1.17.34.D01.1.454.CMB.1.raw
  modified_base (328)..(328): a, c, t, g, unknown or other
  misc_feature (328)..(328): n is a, c, g, or t
  modified_base (451)..(451): a, c, t, g, unknown or other
  misc_feature (451)..(451): n is a, c, g, or t
  modified_base (555)..(555): a, c, t, g, unknown or other
  misc_feature (555)..(555): n is a, c, g, or t
tcagcgtagactagcacgaccggtgctcgatttagatcgtctgtgttgggtttggggatcacaaaacaaccagatttcctcctctaaagaagcccctgggagcacagctcatcaccatggactggacctggaggttcctctttgtggtggcagcagctacaggtgtccagtcccaggtccagttggtgcaatctggggctgaggtgaagcgcctgggtcctcggtgagggtctccgtgcaaggcttcgtggaggcaccttcagcgactatagtttcaagttgggtgcggacgggcctgtggacaaggccttgagtggagtggggaagntcggtaccctagtcgttagacaccaccaaactcgcaacgagacttccgagggcagactccgaacacgtaacccggcgaactaaagttaacgaacacaagttaatacgtaggagtactagaacncgcttagctaatcgtgaacggactacgggtcttaccgttacttcgtagtacgacgtaggtaactaagttaactaactactactcggttaccttaccttttaacncccttaccgttcgtaaccgtttccggtccggtacctacgttaccggtaacccccgttccg

SEQ ID NO: 104439 - DNA, 616 bp, Homo sapiens
  misc_feature: GYAE6OF02HV6OW.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggggtctcctgcaaggcttctggaggcaccttcagccgactatagttcaattgggtgcgacgggcctctggacaaggccttggagtggatgggaagatcgtcctatcgtgacacaccaaactcgacacagaagttccaggcagactcaccataaccgcggacaaataacgaacacaagttaatcgtggagactagaacagcctcgtacatactggaggaccgacgggtacctttacgtacttcgttgtcgtcgaaggtaagttaaactttacgtaacttaacgtaccttacggttcctttacccttttttaacctaccctttaccccttaggttaccctttcggttccgggtacccgttaacgtcccgggttaaccccggttaccccgg

SEQ ID NO: 104440 - DNA, 576 bp, Homo sapiens
  misc_feature: GYAE6OF02F8IH0.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggctctggacaaggccttgagtggagtgggaaggatcgtcctatcgttgacacaccaaactcgcacagaacgtccagggcagactcaaccataacccgcggaactaaaacttaacgaacaacaagttaatacgtaggagactagaaacagcctgtactatctagacggacacggtccttctacttcgtgtcgcgaggagttaatactaatactactgtcttaccttttacacccttccttacgtaccttcgtcgggtacctacggtacggtaccccggttacacccgttcc

SEQ ID NO: 104441 - DNA, 552 bp, Homo sapiens
  misc_feature: GYAE6OF02F0Z35.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaaggccttgagtggatgggaagatcgtcctatcgttgacacaccaaactacgcacagacgttccagggcagactcaccataaccgcgaacaaataacgaacacagttaatctaggagctagaacagcctgtctatctgagacacggcttctacttctgtgacgaggagtaattactatacactagtcttaccttttacctacccttcccttagtaccttcgtcgggtcctacgtaccggtaccccggtcccg

SEQ ID NO: 104442 - DNA, 548 bp, Homo sapiens
  misc_feature: GYAE6OF02GL8YA.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaaggccttgagtggatgggaaggatcgtcctatcgttgacacaccaaactacgcacagaagttccagggcagactcaccataaccgcgaacaaataacgaacacagttaatctaggagctagaacagcctgtacatctagaggacacgggtcttactacttctgtgcgaggataattactatacactgcttaccttttactaccttcccttagtaccttcgtcgggaccacgtaccggaccccgtccg

SEQ ID NO: 104443 - DNA, 565 bp, Homo sapiens
  misc_feature: GYAE6OF02FK2GE.17.34.D01.1.454.CMB.1.raw
  modified_base (327)..(327): a, c, t, g, unknown or other
  misc_feature (327)..(327): n is a, c, g, or t
  modified_base (485)..(485): a, c, t, g, unknown or other
  misc_feature (485)..(485): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggctctggacaggccttgagtggatgggaaggatcgtcctancgttgacacaccaaactacgcacagaagtccagggcagactcaccataaccgcggacaaattaacgaacacaagtaatctaggagctagaacagcctgtacatctgacggacacgggcttctacttctgtgcgaggtagtaattactaataacacttntccttcctttttaccacccttcccttcgtacctttcgtcgggtcctacgttacggtaaccccggttccacccgttacccg

SEQ ID NO: 104444 - DNA, 621 bp, Homo sapiens
  misc_feature: GYAE6OF02HAM14.17.34.D01.1.454.CMB.1.raw
  modified_base (283)..(283): a, c, t, g, unknown or other
  misc_feature (283)..(283): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggaccgaaccctaacacgtggtgtcacagtgtcttcacccatcccgtccggacagtacttaccatcgaccacgtaactcctaccaataaaccgacacgccctaacagtaggtagttaggaggtacgccttagactattcctaggaccgaccgaaccgggtccctattacgttaaccgtgttacggacggtaacgtaccgtacccctaggtacgttcccgggtagaccgtaccccgtaacgggccgacgggtcccggttcccttttacggaccgtttcggtacgggggaccctaacggggg

SEQ ID NO: 104445 - DNA, 550 bp, Homo sapiens
  misc_feature: GYAE6OF02JFGWL.17.34.D01.1.454.CMB.1.raw
  modified_base (320)..(320): a, c, t, g, unknown or other
  misc_feature (320)..(320): n is a, c, g, or t
  modified_base (409)..(409): a, c, t, g, unknown or other
  misc_feature (409)..(409): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtcctatcgttgacacaccaaactcgcacagaagttccagggcagactcacataaccgcgacaaataacgacacagtaatctagganctagaacagcctagtcatctagaggacacggtcttactacttctgtgcgagtagtaattactaataactactgtacttaccttttacacccttccttacgtaccttcgtcgggcctacgtccggtaaccccgtcaccgtcc

SEQ ID NO: 104446 - DNA, 573 bp, Homo sapiens
  misc_feature: GYAE6OF02G3U0B.17.34.D01.1.454.CMB.1.raw
  modified_base (285)..(285): a, c, t, g, unknown or other
  misc_feature (285)..(285): n is a, c, g, or t
  modified_base (414)..(414): a, c, t, g, unknown or other
  misc_feature (414)..(414): n is a, c, g, or t
tcagcgtagactagcacgaccggtgctcgatttagatcgtctgtgttgggtttggggacaaaacaaccagattccgtccttctaaagaagtcccctgggagcacagctcatcaccatggactggacctggaggttcctctttgtggtggcagctagctacaggtgttccagtcccaggtccagttggtgcaatctggggctgaggtgaagacgcctgggtcctcggtgacgggtctcctgcaaggcttctggagcaccttcagcgactatagtttcaattgggtncgacgggcctcgtggacaaggccttgagtggatgggaagatcggtccctatcgttgacacaccaaactcgcacagaacgttcagggcagctacaccataaccgcggaacaacttaacgacacagttaanctaggactactagaacacgcctgtacatctagacgacacgggtccttcgtacttctgtacgacgaggtagttaacttactaatacgtactcgtacttccttttacaccttacctcgtacttcgtacggtcctagtaccggtacccgtctacccgttccg

SEQ ID NO: 104447 - DNA, 531 bp, Homo sapiens
  misc_feature: GYAE6OF02FF3F7.17.34.D01.1.454.CMB.1.raw
  modified_base (319)..(319): a, c, t, g, unknown or other
  misc_feature (319)..(319): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaccaaactacgcacagaagtccagggcagactcaccataaccgcggacaaataacgaacacagtaatctagagctgaacagcctgtcatctagacggacacgggcttctacttctgtgcgagagtaattactataacactgctaccttttacaccttcctgacttcgtcgggccagtcggacccgtcaccgtcc

SEQ ID NO: 104448 - DNA, 589 bp, Homo sapiens
  misc_feature: GYAE6OF02HJIAK.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggctcgtggacaaggccttgagtggatggggaaggatcgtccctatcgttgacacaaccaaactaccgcacagaagttccaggcagactacaccataacccgcggaacaaattaacgaaaccactaagttaatacgtggagtctagaacagcctgtcatctaggacgacgacgggctttactactttcgtgtcgacgtaagggacttaaattactaatacctacttacggtcctttaccttttaccacccttcccttagtacctttcggtcgggaccctacggtaccggtaccccggtccg

SEQ ID NO: 104449 - DNA, 550 bp, Homo sapiens
  misc_feature: GYAE6OF02HROAY.17.34.D01.1.454.CMB.1.raw
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagatcgtcctatcgtgacacaccaaactacgcacagaagttccagggcagactcacataccgngaacaaataacgaacacattaatctaganctagaacacgcctgtcatcngacggacacggcttactactctgtgcgaggagtaacttatataactactgtcttaccttttacacccttcccgttagtacctttcgtcgggtaccctacgttccggaaccccgtaccg

SEQ ID NO: 104450 - DNA, 544 bp, Homo sapiens
  misc_feature: GYAE6OF02I0L42.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctcgtggacaaggccttgagtggagtgggaaggntcgtccctatcgttgacacaccaactacgcacagaagtccgaggcagactcaccataaccgcgacaaataacgaacacaagtaatacgtaggagctagaacacgcctgtacatcgtgagacgacggtctctacttgtgtgacgagtagtaattactatacatctcttccttttacaccttcctcgtcttcgtcggcctacgtaccggacccgtcaccgtcc

SEQ ID NO: 104451 - DNA, 707 bp, Homo sapiens
  misc_feature: GYAE6OF02HAVG9.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctccgtgcaaggcttcgtggaggcaccttcgagcgactatagttcaagttgggtgcggacgggtcctcgtaggacaaggtccttggaggtcggagtggggaaggactcgtccctagttcgtagacaccaaccaaactcgacaactagtaacgtccgaggcaagacctacaacctaacgtaacccgacggaaactaaaacgttaaaccgaaactaaccgtaaagtttaaacgtaccgtaaggtaacgtaccgttaacggaaaccgtacgtacccgttaggtacctacgttacgtaacggacgggtaaccgaccgggttcctttaccgttaacgtttccgtaggttacgacggtaacgttaacgttaaacttaacgtaactaccgtacgttcgtacctttaccgttttaccacccgtttccttacgtaccgttcggtacgggtacctacggttaccggaccccggttcacccgttacccg

SEQ ID NO: 104452 - DNA, 581 bp, Homo sapiens
  misc_feature: GYAE6OF02IZTNZ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcagactggggctgaggtgcagaagcctggggcatcagtgactgtctcctgcaaggccagtggatatatcttcacaaaatatggtatgaattgggtgcgacagggcccccggagaagggcttggaggtggggtggggtgggtcaggcggtctttggacggtaaggcacagtatgcaccgaagataggaagggcagagtcacgataccgacggaccacccccgaacgaaccacacgtcctaacatacgacaaacgtcgaacgacgcctaggagagcctaggaccgacgaccgggccttactattacgtgtacgacgtagtaatttcggttttactgttactacgttaccgttaacttaagtttacgtacgttacggtaccttacgttagtaccggg

SEQ ID NO: 104453 - DNA, 560 bp, Homo sapiens
  misc_feature: GYAE6OF02HHX5N.17.34.D01.1.454.CMB.1.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaagggccttggagtggatgggaaggntcgtccctatcgttgacacaccaaactacgcacagagttccaggcagactcaccataaccgcggaacaaataacgaacacaagttaatctaggagctagaacagcctgtacatcgtgacgacgacgggcttctacttctgtgcgaggtagtaattactatacactgtcttaccttttactacccttcccttgtacctttcgtcgggtacctacgttaccggaccccggttacccg

SEQ ID NO: 104454 - DNA, 529 bp, Homo sapiens
  misc_feature: GYAE6OF02G68BK.17.34.D01.1.454.CMB.1.raw
  modified_base (322)..(322): a, c, t, g, unknown or other
  misc_feature (322)..(322): n is a, c, g, or t
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtccctatcgttgacacaccaaactacgcacagaagttccagggcagactcaccataaccgagacaaataacgaacacagttaatctaggagctagaacagcctgtcatctgaggacgacggtcttctacttctgtgcgagagtaatatatacnctgcttcctttacnccttccttactcgtcggccagtcgacccgtctacccg

SEQ ID NO: 104455 - DNA, 654 bp, Homo sapiens
  misc_feature: GYAE6OF02IC1SN.17.34.D01.1.454.CMB.1.raw
  modified_base (257)..(257): a, c, t, g, unknown or other
  misc_feature (257)..(257): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttctggaggcaccttnagcgactatagttcaattgggtgcggacgggcctctggacaaggcccttggatggatggggaaggatcgtccctatcgtgacacaacctaacgtcncaacngaacgttccgaggcagactcgaaccagtaaccgcgaactaattaaccgaacactagtaactcgtaggacgactagaacgacgtaccgtacgtacagtcccgtaggaacggaaccgtacggggtcctttacgttaacctttcgtacggttagaccggtaagggttaagtttaaacttactaactaacgtactcgtacctttttacctttaacccttacccgtaccgtttacgtacccgtttacggtacggtaccgttacggttacccgggtaaccccgtcccgtaccgtttaccccg

SEQ ID NO: 104456 - DNA, 546 bp, Homo sapiens
  misc_feature: GYAE6OF02IM0BT.17.34.D01.1.454.CMB.1.raw
  modified_base (325)..(325): a, c, t, g, unknown or other
  misc_feature (325)..(325): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (460)..(460): a, c, t, g, unknown or other
  misc_feature (460)..(460): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttggagtggatgggaaggntcgtccctatcgttgacacaccaaactacgcacagaacgttccagggcagactcaccataaccgcgaacaaataacgaacacagtaancgtagacgntagaacagcctgacatctagaggacacggcttatactntgtgcgaggtataattactatacactgcctttaccttttacacccttccttagtaccttcgtcggcctacgtccgggacccgtccg

SEQ ID NO: 104457 - DNA, 559 bp, Homo sapiens
  misc_feature: GYAE6OF02IWFA2.17.34.D01.1.454.CMB.1.raw
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaattgggngcgacgggcctcgtggacaagggccttggaggtggagtgggaagntcgtccctatcgttgacacaccaaactacgcacagaagttccagggcagacncaccataaccgcgaacaataacgaacanacgtaatctaggagctagaacagccttgtacactctagacggacgacggcttactacttctagtgcgaggataactatactacactcgtcttaccttttactacccttcccttgtaccgttcgtcgggtacctacgtaccggaccccgtaccg

SEQ ID NO: 104458 - DNA, 622 bp, Homo sapiens
  misc_feature: GYAE6OF02IEHCF.17.34.D01.1.454.CMB.1.raw
  modified_base (301)..(301): a, c, t, g, unknown or other
  misc_feature (301)..(301): n is a, c, g, or t
  modified_base (388)..(388): a, c, t, g, unknown or other
  misc_feature (388)..(388): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggaggttcctctttgtggtggcagcagctacaggtgtccagtcccaggtccagttggtgcaatcgtggggctgaggtgaagacgcctgggtcctcgggtgagggtctccgtgcgaaggcttcgtgggaggccaccttcagacgactatagttcaattgggtgcgacggcctntggacaggccttgagtggatgggagatcgtcctatcgttgacacaccaaacacgcacagaagttccaggcagctacaccataaccgngaacaaattaacgaactactaagttaatcgtagacgactagaacagacctcgtacatcgtagaaggaccgtacgggtctttacttaccgttcgtcggtcgaccggtaaggtacgttaaactttacctaataacctacgttacgtaccttttacccttttaaccgtacccttacccgtttacgttaccgttaccggttccgggtaccctacggttacccggtaccccggtacccg

SEQ ID NO: 104459 - DNA, 754 bp, Homo sapiens
  misc_feature: GYAE6OF02H3PBF.17.34.D01.1.454.CMB.1.raw
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaagtcttctggaggcaccttcagcgactatagtttcaattgggngcgacgggcctctgggacaaggtccttgaggtgagtgggaagntcgtccctatcgttgacacgaccaaactacgcacagaagttccaggcagctcaccataaccgcgaactaaataacgaacacaagttaatctaggacgactagaaccacgtaccttgtactagtaccttagggaacggaaccgacggggtaccctttacgttaacccgtttcgttcggttacgtaccgggtaacgggtaaacggtttaaaaccgtttaaaccgtttaaacgttaaacccgttaaccgtttacgggtttaacccccgtttttaacccccgttttttttaacccgtaaaaccccccgtttttaccccccgttttaaccggttaaccccggtttttttacccggggttaacccggggggttacccccgtttaaacccgggtttacccccggggttaaaccccccccggggtttaaccccccgg

SEQ ID NO: 104460 - DNA, 562 bp, Homo sapiens
  misc_feature: GYAE6OF02I641E.17.34.D01.1.454.CMB.1.raw
  modified_base (420)..(420): a, c, t, g, unknown or other
  misc_feature (420)..(420): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcggacggcctcgtggacaaggcttgaggtggagtggggaaggatcgtcctatcgtgacacacaacacgcacagacgttccaggcagactcaccactaccgcgaacaaataacgaacacagttaatctaggagactanaacgagccgtgtcatcgtgagacgacgggtcttactacgttcgtgtgtacgaggtaacgttaattacttataacgtctagtacctttccttttaccaccttccttcgtacttcgtcgggacctacggtccggaccccgtccg

SEQ ID NO: 104461 - DNA, 639 bp, Homo sapiens
  misc_feature: GYAE6OF02IM17A.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcacttcagcgactatagttcaattggtgcgacggctcgtggacaaggccttgagtggatgggaagatcgtcctagtcgttagacacaaccaaacgtacgcacagtaagtccagggactagacctacaaccaacgtaaccgacgaaactaaaattaacgaacaactaagttaatcgtaggacacgtagaaacgacgtcctagtactaacgtcgtagaacggacgtacgggtccttacgtaacttccgtgtacgtaccgaaggtaattaaacgttaactaacgtaaactactacgtacctttaccgttttaaccctaccgttacccgttacgtaaccgttccggtacggggacctaagtacccgggtaacccccgttaccgacccgttacccg

SEQ ID NO: 104462 - DNA, 591 bp, Homo sapiens
  misc_feature: GYAE6OF02IL4J4.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctctggacaaggccttgagtggatgggaagntcgtcctatcgttgacactaccaaactacgcacagaacgttccgaggcaagactacaccagtaaccgacggaacaaattaacgaaacacgtaagttaatactaggagactagaacagacctagtacatctagacgacgacggtcttactacgttctgtcgacgtaaggtagttaaacttactataacacgttacgtcctttaccttttactacccttacccgttacgtacttcgtacgggtaccctacgttacccggaacccgttccg

SEQ ID NO: 104463 - DNA, 560 bp, Homo sapiens
  misc_feature: GYAE6OF02IK9NZ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggcctctggacaaggccttggagtggatgggaaggatcgtccctatcgttgacacaccaactacgcacagaagttccaggcagactcaccataacccgcggaacaaataacgaacacaagttaatctagagctagaaacagacctgtacatctagaggacacgggcttctacttctgtcgcgaggattaattactatacactgacctttaccttttaccacccttcccttagtaccgtttcgttcgggtcctagttccggaaccccggttccg

SEQ ID NO: 104464 - DNA, 553 bp, Homo sapiens
  misc_feature: GYAE6OF02FJYHN.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtcctatcgttgacacaccaaactacgcacagaacgttccagggcagactcaaccataaccgcgaacaaactaacgaacacaagttaatctaggagctagaacagcctgtcatctgaggacgacggcttcttactctgtgcgaggagtaattactatacactgtcttaccttttacctacccttcccttgtaccttcgtcgggtcctacgtaccggtaccccggtaccg

SEQ ID NO: 104465 - DNA, 573 bp, Homo sapiens
  misc_feature: GYAE6OF02HOQW1.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcacttcagcgactatagttcaattgggtgcgacgggcctctggacaaggccttgagtggatgggaagatcgtcctatcgttagacacaccaaatacgcacagaagttccagggcagactacaccaataaccgcggaacaaattaacgaacaactaagttaatctaggagactagaacagcctagtcatcgagaggacacggtcttactacttcgtgtgcgtaaggtagtaattactaataacacttcgactttacccttttacctacccttcccttgttacctttcggtccgggtacctacgttccgggtaaccccgtaccg

SEQ ID NO: 104466 - DNA, 549 bp, Homo sapiens
  misc_feature: GYAE6OF02GWMEA.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagntcgtcctatcgttgacacacaaactacgcacagaagttccaggcagactcaccataccgcggacaaataacgaacacaagttaatctaggagactgaacagcctgtcatctgaggacacgggcttactacgttctgtgacgaggtagtaattacatacactgctttaccttttaacctaccttaccctttgaccttcgtcgggtcctagttccggaaccccgtccg

SEQ ID NO: 104467 - DNA, 571 bp, Homo sapiens
  misc_feature: GYAE6OF02IN80V.17.34.D01.1.454.CMB.1.raw
  modified_base (327)..(327): a, c, t, g, unknown or other
  misc_feature (327)..(327): n is a, c, g, or t
tcagcgtagactagcacgaccggtgctcgatttagatcgtctgtgttggggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaaattgggtgcgacgggcctctggacaaggccttggagtggatggggaaggntcgtccctatcgttgacacacaaactcgacacagaagttccagggcagactacaccataaccgcgaacaaattaacgaacacagttaatctaggagctagaacagcctgtacatctgacggacacgggtacttactaccttcgtgtgacgtaaggtagtaaattactatacacgtcgtcttaccttttactacccttaccctttacttcgtcgggtacctagtaccggtaccccgtctaccccg

SEQ ID NO: 104468 - DNA, 557 bp, Homo sapiens
  misc_feature: GYAE6OF02H02JX.17.34.D01.1.454.CMB.1.raw
  modified_base (280)..(280): a, c, t, g, unknown or other
  misc_feature (280)..(280): n is a, c, g, or t
  modified_base (415)..(415): a, c, t, g, unknown or other
  misc_feature (415)..(415): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgcttgggtcctggtgagggtctcctgcaaggcttctggaggcaccttcagcgactatagttcaattgggtncggacggcctctggacaaggtccttggagtggatgggaaggatcgtcctatcgttgacacaccaaactacgcacagaacgttcaggcagactcaccataaccgcgaacaaataacgaacacagttaatctagganctagaacagacctgtacatctagacggacgacggcttactacttcgtgtgcgaggaagttaatactataactactgtcctttaccttttacacccttcccttagtaccttcgtcgggtacctacgtccggtaccccgtaccg

SEQ ID NO: 104469 - DNA, 552 bp, Homo sapiens
  misc_feature: GYAE6OF02IJFNG.17.34.D01.1.454.CMB.1.raw
  modified_base (322)..(322): a, c, t, g, unknown or other
  misc_feature (322)..(322): n is a, c, g, or t
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (505)..(505): a, c, t, g, unknown or other
  misc_feature (505)..(505): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacaccaaactacgcacagaacgttccaggcagactcaaccataacccgngaacaataacgaacacagtaatctgancgtanaacagcctgtacatctagaggacacgggtcttcgtacttctgtgcgtaggacgtaattactatactactagtcttaccttttaccncccttccttagtacttcgttcgggaccacgtccggacccgttacccg

SEQ ID NO: 104470 - DNA, 573 bp, Homo sapiens
  misc_feature: GYAE6OF02F02R7.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagtccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctgggacaaggccttgagtggatgggaagntcgtcctatcgttgacacaccaaactacgcacagaagttccagggcagactcaccataaccgcgaacaataacgaacacagtaaataggagactagaacagcctgtcatcgtagacgacgaccgggtcttctacttcgtgtgacgtagaagttaataacgttaataacacgtacgtcttaccttttaacctacccttcccgttacgtacttcgtcgggtcctaacgtccgggtaccccggtacgtacccg

SEQ ID NO: 104471 - DNA, 592 bp, Homo sapiens
  misc_feature: GYAE6OF02G1RWK.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggagtgggaaggntccgcctatcgttgacacaccaaactacgcaacagtaacgttccgagggcaagactacacccataacccggcggaacaaacttaacgaacacaacgttaaatctaggagctgaaaccgagcctagtcatctgacggacgacgggctttccgtactttcgtgtcgcgtaaggagtaattactaatactacgtagtcttacctttttaccaccctttaccctttacttccgttcgggtacctacgttacggtacccccggttctacccgg

SEQ ID NO: 104472 - DNA, 543 bp, Homo sapiens
  misc_feature: GYAE6OF02HG6IM.17.34.D01.1.454.CMB.1.raw
  modified_base (291)..(291): a, c, t, g, unknown or other
  misc_feature (291)..(291): n is a, c, g, or t
  modified_base (412)..(412): a, c, t, g, unknown or other
  misc_feature (412)..(412): n is a, c, g, or t
  modified_base (494)..(494): a, c, t, g, unknown or other
  misc_feature (494)..(494): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgagtcctcggtgagggtctcctgcaaggcttctggaggcaccttcagcgactatagtttcaattgggtgcgacgggcctntggacaaggccttgagtggatgggaaggatcgtccctatcgttgacacaccaaactcgcacagaagttccagggcagactcaccataaccgcggacaaatacgaacacagtaactctgganctagaacagctgtcatctgagacacgggcttctacttcgtagtgcgagtaagtaattataatacactgtccttccttttacncccttccttcgtacttcgtcgggtccacgtcggtaccccggtctacccg

SEQ ID NO: 104473 - DNA, 653 bp, Homo sapiens
  misc_feature: GYAE6OF02GZW42.17.34.D01.1.454.CMB.1.raw
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaattgggtgcgacggcctcgtggacaaggccttaggaggtggagtgggaaggatcgtcctagtcgttgacacaaccaaactcgcacagaacgttcaggcagactacaccgactaaccgcggaactaaactaacgaacaacgtaagttaactacgtaggaacgtactagaaacagaccctagtacctatacgtagacggtacgtacgggtacttactacgttacgtcggtcgacgtaggtaagttaacttacgtaaacttaaccgacgttacgttacctttaccgttttaaccctacccgtttacccgttacgtaccgtttaccggttacggggtaccctaacgggttacccgggtaacccccgttccgtaacccgttccccg

SEQ ID NO: 104474 - DNA, 597 bp, Homo sapiens
  misc_feature: GYAE6OF02FUIH8.17.34.D01.1.454.CMB.1.raw
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (469)..(469): a, c, t, g, unknown or other
  misc_feature (469)..(469): n is a, c, g, or t
tcagcgtagactagcacgaccggtgctcgatttagatcgtctgtgttggggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggtctcctgcaggcttctggaggcaccttcagcgactatagttcaattgggtgcgacggcctcgtggacaggccttgagtggagtgggatgggaccgaacctaacacgtcggtagtaccacgagtgtaccttaccaacccagtcccgtcgggacaggtccttaacatcgaaccacgaacctcctacaactaaaccncacgcctaanagtacggacgttggacggacgcctagaccagttcnggaccgacgacggtaccgtactattacgtgtacgcgacgtcgtacccgagagtcccgggagacggtccgtaacgggccacggtccggtcctttaggaccgtttcggacggggtaccgagggtacccgg

SEQ ID NO: 104475 - DNA, 640 bp, Homo sapiens
  misc_feature: GYAE6OF02IAOTA.17.34.D01.1.454.CMB.1.raw
  modified_base (269)..(269): a, c, t, g, unknown or other
  misc_feature (269)..(269): n is a, c, g, or t
  modified_base (389)..(389): a, c, t, g, unknown or other
  misc_feature (389)..(389): n is a, c, g, or t
tcagcgtagactagcacgaccggtgctcgatttagatcgtctgtgttgggtttggggacgaaacaaccagattcctcctctaaagaagccctgggagcacagctcatcaccatggactggacctggaggttcctctttgtggtggcagcagctacaggtgtccagtcccaggtccagttggtgcaatcgtgggctaggaggtgaagcgcctggggtcctgggtagagggtctccgtggacaaggcttcgtgggaggcctaccttcgagngactatagtttcaattgggtgccgacgggcctcttggacaaggccttgagtggaattgggaaggatcgcctagtcgttgacacacaaactcgacgacagtaacgtcagggacagactacncaagtaaccgcggaacaaactttaacgaacactagtaaatcgtagaacgctacgaatacgactctagactacgtgacgtaacgtacgggcctttacttaccgttacacgttcggacggtaacggtaagttaacggtttaaacctaagtaaacttacgacgttactttacccgttttaaccaccctttccgttacgttaccgttacgtcggggtacccaccgttacgggtacccctacgtacccgttacccg

SEQ ID NO: 104476 - DNA, 581 bp, Homo sapiens
  misc_feature: GYAE6OF02HKPFR.17.34.D01.1.454.CMB.1.raw
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggtccttgagtggatgggaagatcgtcctatcgttgacacaccaaactacgcacagaagttccaggacagactacaccagtaaccgngaacaataacgaacacagttaanctagganctagaacagcctgtacactcgtagacggactacgggtccttacgtacttctgtacgtacgaggtattaacttactagtaacacgttcgtacctttacctttttaccaccctttcccgttagtaccttcggtacgggtcctaacgttccgggaccccgttacccg

SEQ ID NO: 104477 - DNA, 537 bp, Homo sapiens
  misc_feature: GYAE6OF02IJE16.17.34.D01.1.454.CMB.1.raw
  modified_base (259)..(259): a, c, t, g, unknown or other
  misc_feature (259)..(259): n is a, c, g, or t
  modified_base (324)..(324): a, c, t, g, unknown or other
  misc_feature (324)..(324): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (475)..(475): a, c, t, g, unknown or other
  misc_feature (475)..(475): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtgcgacgggcctcgtggacaaggccttggagtggatgggaagntcgtcctatcgttgacacacaaactcgcacagaacgttccaggcagactcacataccgcgacaatacgacanagtaancgnganctagaacngctgtacatctagacgacacgggtcttactacgttctgtcgcgagattaatactatacncgtcgtcctttcctttaccaccttccttagtccttcgtcggacctagtcccggacccgtccg

SEQ ID NO: 104478 - DNA, 565 bp, Homo sapiens
  misc_feature: GYAE6OF02JKTI3.17.34.D01.1.454.CMB.1.raw
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
tcagcgtagactagcacgaccggtgctcgatttagatcgtctgtgttgggtttggggagtcacaaaacaaccagattcctcctctaaagaagccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcggacgggcctctggaccaaggcctgagtggatgggagntcgtccatcgtnacacaccaactcgcacagaagtccagggcagactcaccataacccgnggacaaataacgaacacagtaatactagagtcagacagacgtgtcctatctagacggaccgacggtcttactaccttcgtcgtagcgtaggagtaacgttactaatactacgtgtccttaccttttaaccacccttccttacgtacgtccgttcgggtacccacgttacggaccccgttaccgg

SEQ ID NO: 104479 - DNA, 551 bp, Homo sapiens
  misc_feature: GYAE6OF02HKJ8Z.17.34.D01.1.454.CMB.1.raw
  modified_base (407)..(407): a, c, t, g, unknown or other
  misc_feature (407)..(407): n is a, c, g, or t
  modified_base (456)..(456): a, c, t, g, unknown or other
  misc_feature (456)..(456): n is a, c, g, or t
  modified_base (475)..(475): a, c, t, g, unknown or other
  misc_feature (475)..(475): n is a, c, g, or t
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctctggacaaggccttgagtggatgggaagatcgtccctatcgttgacacaccaaactacgcacagagttccagggcagactcaccataaccgcgacaaattacgaacacagttaanctgagctagaacagctgcatctgacgacacgggtcttctacttctgtgngagagttaatactataacnctagctttacgtttcctaccttccttactacgtttcgtcgggtacctacgtccgggaacccgttccgtaccgtccc

SEQ ID NO: 104480 - DNA, 539 bp, Homo sapiens
  misc_feature: GYAE6OF02HZ1FV.17.34.D01.1.454.CMB.1.raw
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagaagcctggggcctcagtgaaggtctcctgcaaggcttctggattcacgtttacctcctatagtatcaactgggtgcgccaggccgctggacaacgacctgagtggatgggatgggcaaaccctanactggtgtcacagtgtcttcacccntcccncggacagacttaccatcgaccacgaactcctaccataaaaccncacgcctaacgatggagttgaggacgctgacatcngacaccacggccgtactattacngtcgcgaagtgtacccagngtaccggngacgcctacggcaggtcgcctttcggaccttcggtggggcctacgggg

SEQ ID NO: 104481 - DNA, 571 bp, Homo sapiens
  misc_feature: GYAE6OF02GELIN.17.34.D01.1.454.CMB.1.raw
  modified_base (417)..(417): a, c, t, g, unknown or other
  misc_feature (417)..(417): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaattgggtgcgacgggcctctggacaaggccttgagtggatgggaagatcgtcctatcgttgacacaccaactacgcacagagttccagggcagactacaccataacccgcggaacaaattaacgaacacaagttaactcgtagganctagaacagcctgtcatctgacgacacgggtcttctacgttctgtgcgaggtataattactaataacactgccttaccttttaacacccttcccttacgtacctttccgtcgggtaccctacgttaccgggtaaccccggttctacccgttccc

SEQ ID NO: 104482 - DNA, 664 bp, Homo sapiens
  misc_feature: GYAE6OF02JN9B3.17.34.D01.1.454.CMB.1.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (329)..(329): a, c, t, g, unknown or other
  misc_feature (329)..(329): n is a, c, g, or t
tcagcgtagactagcacgaccggtgctcgatttagatcgtctgtgttgggtttggggtacgaaaacaaccagattcctcctctaaagaagcccctgggagcacagctcatcaccatggactggacctggaggttcctcttgtggtggcagcagctacaggtgtccagtcccaggtccagttggtgcaatctggggctggaggtgaagcgcctgggtcctcggtgagggtctcctgcaaggtcttcnggagcaccttnagcgactatatttcaattggggtncggacgggcctcgtggactaaggcctttaggacgtggagtagggaagntccgtccctaagtcgttagaactacaaccgtaaactcgacacgaggtaacgttccgagggctaagacctcaccgaataaccgggaactaaatacgaacatagtaactcgtaggtagctaggaacacgtacctgtaccattacgtagacgacgacggtctttaccgtacgtttccgtagtcggacggtaacgggtaattaacgtttaaaccttaagtaacctacctcggttaccttacccgttttttaacccaccctttaccgttacgttaccgttacggtacccggggtccttaaccggtacccgggtaacccccgttcgtaaccccgttacccg

SEQ ID NO: 104483 - DNA, 567 bp, Homo sapiens
  misc_feature: GYAE6OF02G2GOX.17.34.D01.1.454.CMB.1.raw
  modified_base (323)..(323): a, c, t, g, unknown or other
  misc_feature (323)..(323): n is a, c, g, or t
  modified_base (420)..(420): a, c, t, g, unknown or other
  misc_feature (420)..(420): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctagggtcctcgggtgagggtctcctgcaaggcttctggaggcaccttcagcgactatagtttcaattgggtgcgacgggcctctggacaaggcctgagtggatgggaagntcgtccctatcgtgacacaccaaactacgacacagacgttccagggcagactcaccataacccgcggaacaaataaccgaacacagttaatcagganactagaacagcctagtcatctgaggacgtacgggtcttactacttctggtagcgaggagttaatactaatacacttacgtcttaccttttacacccttcccgttagtacctttcggtcggtaccacgttaccgggtaccccgtaccg

SEQ ID NO: 104484 - DNA, 621 bp, Homo sapiens
  misc_feature: GYAE6OF02I4JXR.17.34.D01.1.454.CMB.1.raw
  modified_base (325)..(325): a, c, t, g, unknown or other
  misc_feature (325)..(325): n is a, c, g, or t
  modified_base (438)..(438): a, c, t, g, unknown or other
  misc_feature (438)..(438): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttagggtcgactcaccctnccccgattaacgtggacaggacccttggtcttccggcgagcgggcttttcaccgtctttatcgttacttatgtcagcattcgcacttctgactacctcacgcatcgcctcacncgcacctaccgttcaccacggtcttaacgaacgaaccgtccctacccccttaaccccaaaccgtaaccgactaaactaacgccgtaccgccgtacgccgccagtccgttacggtgctagttcggtttaacgtccccgtttcacttcccttcccgccctcttcctagtaccttagttccgtacg

SEQ ID NO: 104485 - DNA, 633 bp, Homo sapiens
  misc_feature: GYAE6OF02IA4YX.17.34.D01.1.454.CMB.1.raw
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
  modified_base (438)..(438): a, c, t, g, unknown or other
  misc_feature (438)..(438): n is a, c, g, or t
tcagcgtagactagcacgaccggtgctcgatttagatcgtctgtgttgggtttggggacaaaacaaccagattcctcctctaaagaagccctgggagcacagctcatcaccatggactggacctggaggttcctctttgtggtggcagcagctacaggtgtccagtcccaggtccagttggtgcaatcgtggggctggaggtgaagacgccgtgggtcctcgggtgagggtctcctgcaaggcttcgtggaggccacttcagcgactatagtttcaagttgggtgcggacgggctntggacaaggccttgagtgggagtgggaagctcgtccctagttcgttgacaccaaccaacgtacncacagaagttccgagggcacgactaccaccaagtaaccgcgaactaaaagttaaccgaacactaagtaatcgtagganctagaacagtcctagtcatcaggacgacacgggccttacgtaactttcgtgtcgacggtaggtaaacgtttaattaactaacgttaacacgttacgtccttttacccgttttaacctacccttcccttacgttaccttcggtcgggtaccctaacggttacccgggtaacccccggttaccgtacccgttccccg

SEQ ID NO: 104486 - DNA, 583 bp, Homo sapiens
  misc_feature: GYAE6OF02I930V.17.34.D01.1.454.CMB.1.raw
  modified_base (292)..(292): a, c, t, g, unknown or other
  misc_feature (292)..(292): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattggtgcgacggcctntggacaaggccttgagtggatgggaaggatcgtcctatcgtgacacaccaaactcgcaacagaagttccgaggcaggacctcaccataaccgcgaacaaataacgaacactaagtaatctaggacgtctagaacagcctgtacatcgtagacggacgacgggtcttacgtacttctggtacgcgaggtacgttaatacgtaactactactacgtcctttaccttttaactccctttaccctttaccttcggttacgggtccctagtaccggtaccccggttcctaacccgg

SEQ ID NO: 104487 - DNA, 548 bp, Homo sapiens
  misc_feature: GYAE6OF02F9Y3Z.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaaggatcgtccctatcgttgacacaccaaactacgcacagaagttccagggcagactcacataaccgcgaacaaataacgaacaacagttaatctgagctagaacagcctgtcatctgacgaccacgggcttactacttctgtgcgaggtagtaatactatacactgtcttccttttacaccttcccttagtacctttcgtcgggccctacgtccggtaccccgtcccg

SEQ ID NO: 104488 - DNA, 560 bp, Homo sapiens
  misc_feature: GYAE6OF02GLX73.17.34.D01.1.454.CMB.1.raw
  modified_base (246)..(246): a, c, t, g, unknown or other
  misc_feature (246)..(246): n is a, c, g, or t
  modified_base (515)..(515): a, c, t, g, unknown or other
  misc_feature (515)..(515): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggtctcctgcaaggcttcnggagcaccttcagcgactatagtttcaagtttgggtgcggacgggcctctggacaggccttgagtggatgggagatcgtccctagtcgttgacacaccaactacgcacagaagtccaggcagactcaaccataaccgcggaactaaactaacgaacacaagttaatcgtaggacgactagaacagactcgtacatctagaggacgacggtcttcgtaccttctgtcgtacgaggtagtaattactaatactactagtcttcctttaccnccttccttacgtacttcgtcggacctacgtaccggtacccgtccg

SEQ ID NO: 104489 - DNA, 877 bp, Homo sapiens
  misc_feature: GYAE6OF02JZTJC.17.34.D01.1.454.CMB.1.raw
tcagcgtagactagcacgaccggtgctcgatttagatcgtctgtgttgggtttggggagtcacaaaacaaccagattcctcctctaaagaagccctgggagcacagctcatcaccatggactggacctggaggttcctctttgtggtggcagcagctacaggtgtccagtcccaggtccagttggtgcaatctggggctgaggtgaacgtacgcctggggtcctcgggttagacggggttcctccgtggaccaagggtcctttcgtagggaacgggtcctaacccctttgacggtaccggaacttaagttacgttttaccgaaagtttgggggttacgtaccggaaccgggggtcccttcgttacggggaacctaaacggggtcccgttttaggaacggtttgggaaacggttagggggtaaacgggtaacgttccgggttaccccgttaaagttccggttttaacgggaacctaaccgtaacccgtaaaaaaccgttccggctaaaccgaagggtaaacgtttcccggaaggggtaccaacggtaacctaccgtaaaccccgtaacgttaaaccccggaccgggtaaacctaaaacgtttaaaccggaaacctaacgtaacgttttaaacgtacgttacgggtaacgtcgttaaggaaacctaaacgtccgttacgttactaacgtaccgtaggtacgggaaccgtaacggggtctttacggttaactttccgtggttacgacgggtaggtaaacgttaacttaacgttaacgtaacgtacgttacggtacctttaccctttttaacgaccccgtttaccgttacgttaccggttaccgtacggggttaccacgtttaccgggaaccccgttacgg

SEQ ID NO: 104490 - DNA, 806 bp, Homo sapiens
  misc_feature: GYAE6OF02HIKQS.17.34.D01.1.454.CMB.1.raw
tcagcgtagactagcacgaccggtgctcgatttagatcgtctgtgttgggttggggacgaaaacaaccagattcctcctctaaagaagcccctgggagcaccagctcatcaccatggactggacctggaggttcctctttcgtggtggcagcagactacaggtgtccagtcccaggtcccagttcggtcgctaattcgtggggctaggaaggtgaaacgaacgccgtcggggcctcgaggtcgaacggtctccgtgactaaggcttctggtacttctaccgtttacctacctatacgtatcaaactgggtcgcgccaggccgcttcggaacaacgacctggacgtggactggggacgtcggggaccgtaaaccctaacgaccgttcgggtacgtacaaccgtagggttcgtaccttaccgacccgtacgttcccggttaccggggaactaacggtaaccctttaaccgaacttaccggaaaccctaaccggtaaaccctttcccgtaacccgaaactttaaaacccgaacctaacggtaacccccttaaagaaacggtttcgggttaacggtttacggaaacggggttacgtacccgttacggaaacccgttacttacgtacggaaccgtaaccggtacccggtccgttagttaacttttccgcggttacgaccggtaaggaccctacccgtaacgtaccgtacgggtacgtaacggtccccgttaacgggcgtacggtcccggtttaccgtttacggtaccggtttccggtacggggacccttacggggtacccgttaccccggg

SEQ ID NO: 104491 - DNA, 582 bp, Homo sapiens
  misc_feature: GYAE6OF02GU8RM.17.34.D01.1.454.CMB.1.raw
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagatcgtcctatcgttgacacaccaaactacgcacagaacgtccgaggcagactcacataccgngaacaaatacgaacacaagttaactctagganctagaacacgtcctagtcatcgtagacgacgacggtcttacttaccttcttgtacgcgaaggtacgttaaattaccgtaactactacgtcgtcctttaccttttaaccaccctttcccgttagtacctttcgtacgggtaccctacgtccggtaaccccgttcccg

SEQ ID NO: 104492 - DNA, 808 bp, Homo sapiens
  misc_feature: GYAE6OF02HBLAQ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggcttctggaggcaccttcagcgactatacgtttcaagttgggtgcggacgggcctcgtcggacaaggtccttggacggtgggagtggggaaggtactccggttccccgtaagttccggttacggaacctaacccgtaacccaaaacgttaccggaccaacgtaaacggtaacggtttacccgaaagggggtcccaaacggtaacccttaccgaaaccccgaaacgttaaaccccggaccgggaaaacctaaaaaccgtttaaaccgaaacccgtaaacgtaaacggttttaaacgtaccgtaagggaacgtacgtaacggaaaccacgtcccgttacgtacctacgttcgtaacggacggtaaccgtaccgggtactttaccgtacgtttccgtaggttacggtaccggtaagggtaacgttaaaacgttaccgttaacgttaacctacggttaccgttaacccttttaccctttttaacccgtacccctttaccccgtttacgttaccgttttaccggttaccggggtacccgttaacggttacccgggtaacccccggttacccgg

SEQ ID NO: 104493 - DNA, 710 bp, Homo sapiens
  misc_feature: GYAE6OF02JQHTK.17.34.D01.1.454.CMB.1.raw
  modified_base (335)..(335): a, c, t, g, unknown or other
  misc_feature (335)..(335): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtggaggcaccttcacgcgtactatagtttcaagttgggtgcggacgggcctcgtggacaaggtccttggacggtggtagtagggaaggtntaccggtcccgttagttcgttgaactacgaacctaaacgtacgaccaacgacgtaacgttccgagggacaacgtacctacaaccgaagtaaacccgaccggaactaaaacgtttaaccgaacaacgtaagttaaacgtacgttaagggacgactacggaaactaacggacctacgtacacgtttacgaacggtacggaaccgtacgggtactttacctaccgtttacgtacggtacgacggtacggtaagttaacttaacgtaacttaacgtacttacgtcctttaccttttaaccgtccgttaccgttacgtaccgtttcggtacccgggtacctacgttacccgggtaaccccggttacgtaccccgttcccg

SEQ ID NO: 104494 - DNA, 574 bp, Homo sapiens
  misc_feature: GYAE6OF02G3VS7.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctctggacaaggccttgagtggatgggaagntcgtcctagtcgttgacacaccaactacgcacagaacttcgaggcagactacaccactaaccgacgaacaaactaacgaacacaagttaatcgtagacgctagaacacgacctgtctatcgagacgacgtcggtcttacgtacgttcgtagtcgacgtaaggtacgttaattactaatacctagttcgtcctttaccttttacacccttccgttgtaccttcggtcggactacgtaccggtacccgtaccg

SEQ ID NO: 104495 - DNA, 570 bp, Homo sapiens
  misc_feature: GYAE6OF02I0U9N.17.34.D01.1.454.CMB.1.raw
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggcaccttcagcgactatagtttcaattgggtgcgacgggcctgtggacaaggccttgagtggatgggaagntcgtcctatcgttgacacgaccaaatcgcaacagaagttccagggcagactcaccagtaaccgcggaactaaacgttaacgaacaactaagttaatactaggacgtctacgaacacgacctagtactatctagacgacacgggtcttacgtacttctgtgtcgaggtataacttactaataatactgtcttaccgttttaaccaccttccgttagtacttcgtcggtcctagtacggacccgtcaccgtcc

SEQ ID NO: 104496 - DNA, 594 bp, Homo sapiens
  misc_feature: GYAE6OF02JNGPA.17.34.D01.1.454.CMB.1.raw
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
tcagcgtagactagcacgaccggtgctcgatttagatcgtctgtgttgggtttggggtagtcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggtcctgagtggatgggaagatcgtccctatcgtgacacaccaaatcgcacagagttccgagggcagacncaccanaaccgcggacaaatacgaacacagttaatctagganctacgaacagcctagtcactcgtgaaggaccgacggtcttcgtacttacgtgtacgcgtaaggtacgttaacgttactaacgtactaacgtcgtacctttacctttttaaccaccccgttaccgtttaccgtactttcggtccgggtaccgtacgttaccgggtaacccccggttaccg

SEQ ID NO: 104497 - DNA, 806 bp, Homo sapiens
  misc_feature: GYAE6OF02JQJE8.17.34.D01.1.454.CMB.1.raw
  modified_base (262)..(262): a, c, t, g, unknown or other
  misc_feature (262)..(262): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctgggtagagggtctccgtgcgaaggtcttcgtggaggccaccttnacggcgactatagtttacaagttgggtgcggacggcctactggacaggccttggagttggagtggggaagtagttccgtcccgttaattcggttacgaacaccaaccgtaaaacttcggcctaacgtagtaaacgtttccccgaaggggtccaaagtacccgttacaaccgtaaaccgttaacccggggaacgaaacccgtaaaaattttaaacccggaaacgtaaacgtaacgttaaacttaacgtacggtacgtacgtaacgaacgtaacgtaccttagtaccgtacgtacgtacggaacggtaccggtaacgggtccgtttaccgttacgtttaaccgttcgggtaccggtaaccgggtacgggtaaaacgtttaaacgttaaaccgtttaaacgttaaccgtaaccgtttacggttacctttacccgtttttaacccttaccctttaacccgtttaccgtaccgtttaaccggttccgggggtaacccttaaccgggttacccgggtaacccccggttacccgttaccccgttaccccgg

SEQ ID NO: 104498 - DNA, 577 bp, Homo sapiens
  misc_feature: GYAE6OF02HS9N5.17.34.D01.1.454.CMB.1.raw
  modified_base (435)..(435): a, c, t, g, unknown or other
  misc_feature (435)..(435): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattggtgcgacgggcctcgtgacaggccttgagtggatggagatcgtcctatcgtgacacgaccaaatacgcacagagttccagggcagactcaccataaccgcggaacaaataacgaacaactaagtaatcgtaggacgactagaacagcctgtcagtcngaggacacgggtcttactactttcgtcgtgacgtaaggtagttaaagttactaactaacgtacttcgtacctttacccttttactacccttcccttagtaccgtttcgtccgggtacctacggttaccggtacccgtacccg

SEQ ID NO: 104499 - DNA, 772 bp, Homo sapiens
  misc_feature: GYAE6OF02GWN9F.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttctggagcaccttcagcgactatagtttcaagttgggtgcggacgggcctcgtggacaaggtccttggagtggatgggaaggctcgtcctagtcgttgacacaaccaactacgacacgagaacgttccgagggtacacggaactcgaacctaacgtaaacccgacggtaaacctaaaacgtttaaaccgaaaacctaacgtaaacgtttaaactacggttacgggaacgtaccgttaacgaaaccgaacggtacccgttacggttaccgtaacttccgttacgggaacggtaacccggtaaccggggtacccttttaccgttaccgttttaccgttcgggttacggtaaccggtaaaggggttaacgtttaaacgtttaaccttaaacgttaaccgtaacgtttaccgtacctttttacccgttttttaaccctaaccccttttacccgttccgtttaacccgtttccggttacgggtacccttaccggttacccgggtaacccccggttaccgtaccccggttaccccg

SEQ ID NO: 104500 - DNA, 652 bp, Homo sapiens
  misc_feature: GYAE6OF02HUX4A.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaatgggtgcgacgggcctcgtggacaaggtccttgagtggagtgggaaggagtcgtccctatcgttgacacacaaactacgcacagagttcaggcagactcaccataaccgacggacaaacgttaacgaacaacgagttaaatctaggagactagaaacgagtaccttgtacacttccgtagaacggaccgacgggtacctttaccgtaactttcgtgtcgtcggtaacgggaagttaaatttacgtaattaaccctacgttacggttccttttaaccccgtttttaacctacccctttacccgtttaccggttaacctttccgggtttaaccggggaccccttaacggttacccgggttaacccccccggtacccgg

SEQ ID NO: 104501 - DNA, 802 bp, Homo sapiens
  misc_feature: GYAE6OF02H3R3C.17.34.D01.1.454.CMB.1.raw
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttactggaggccaccttcagcgactatagtttcaattggggtgcggacgggtcctcgtggacaaggtccttggagtggagtgggagntcgtcctagtcgttanactacaccaaactaccgacacgagtaacgttccgagggacagacctaccaacccgtaacgtaacccggacggaaacctaaaacgtttaaaccggaaacctaacgttaaacggttttaaaacgtccgttaagggaaacgtacgttaacggaaaacccgtacggtacccgttacggttacctaacgttaccgttaacgggaaacgggtaaccggtaaccggggttacccttttaccgtttaacccgttttccgttagggttaccgggtaacgggttaaacggggtaaacgttttaaaacgttaaccgttaaacgttaacccgttaaccgtttcggttaacccctttttccccgttttttaacccctaccccgtttaccccgttttacggtacccgttttaccgggttaccggggtaccccttacggttacccccggggtaacccccgtttaccccgg

SEQ ID NO: 104502 - DNA, 555 bp, Homo sapiens
  misc_feature: GYAE6OF02I7PX0.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcggacgggcctctggacaagggccttgagtggatgggagatcgtccctatcgttgacacaccaaactacgacacagaagttccagggcagactcaccataaccgcgaacaaattaacgaacacaagttaatctggagctagaacagcctagtcatctagacggacgacggcttctacttcgtgtagcgagagtaattactatacactgtcttacctttacacccttccttagtacctttcgtcgggacctacgtacggtaccccgttacccg

SEQ ID NO: 104503 - DNA, 617 bp, Homo sapiens
  misc_feature: GYAE6OF02GQL8U.17.34.D01.1.454.CMB.1.raw
  modified_base (370)..(370): a, c, t, g, unknown or other
  misc_feature (370)..(370): n is a, c, g, or t
  modified_base (584)..(584): a, c, t, g, unknown or other
  misc_feature (584)..(584): n is a, c, g, or t
tcagcgtagactagcacgaccggtgctcgatttagatcgtctgtgttgggtttggggtacgatttgatgttacctgatgcttagaggcttttcctggaaggcagggcatttgttagcttcagcaccgtagtgcctcgtcatcacgcctcagccttgattttccggatttgcctggaaaaccagcctaccgcttaaaccggacaaccgtcgcccggccaacatagccttctcccgtcccccttcgcacgtaaccaccaagtacaggaatacttaacctgtttcccatcactcgccttcggcctcgccgttagggcactcaccctgccccgtattaacggtcggacacggtaccccgttggtccgttccggngacggcgggtcttttccgacccgtctttactcgtttacttatgtacacggtctacttcgctacttctagtactacctccagctatcgcctcacagccaacctccttacacacgtcttaacaacgaacccgccttacccccaccaaaccacgccaataacgcgtcgcctcgccgcacgtccttcgcgctagttacggtttccgtccccgtttacnccttccgtccgcctactccgtcgacttcgctcg

SEQ ID NO: 104504 - DNA, 573 bp, Homo sapiens
  misc_feature: GYAE6OF02G8DX2.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgaggtggatgggaaggatcgtcctatcgttgacacaccaaactacgcacagaagttccaggcagactcaccataaccgcggaacaaacttaacgaacaacaacgttaaatactaggagctagaacagcctagtcatctgaggacgacggtcttacttacttactgtgtacgaggagtaaattactactactactacgtcttaccttttacctacccttcctttacgacctttcgtcgggtcctacgtccggtaaccccggtacccg

SEQ ID NO: 104505 - DNA, 716 bp, Homo sapiens
  misc_feature: GYAE6OF02IASCF.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggcttcgtgggaggcctaccttcgagccgtactattagtttcgaagttgggtgcggacgggtccttcgtacggacgaaggtccttggaggtggagtgggaagtcgtccgtcctagtcgttagaccacaccaacgtacgacacagacgtacgagggacacgactacacacgtaacccggacggtaactaaacgttaacgaacctaacgtaaacgtttaacgtacgtagggaacgtacgtaacggtaaccgtacgtacccgttagttacctacgttaccgtaggaacggaccgtacgggttacctttaccgttaccgtttcgtaggtcggtacggtaaggttaacttaaacgtttaacctagtaaccgttacgttcgttaacccttttacccgttttaccctaccccgtttaccctttacggttacccgtttaccggtaccgggttaccctacggttacccgggtacccccgttacccg

SEQ ID NO: 104506 - DNA, 556 bp, Homo sapiens
  misc_feature: GYAE6OF02IZLLQ.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtccctatcgttgacacaccaaactacgcacagaagttccagggcagactcacataaccgcgaacaaattaacgaacacattaatctaggagctgaacagccttgtcatctgaggacaccgggcttctacttctgtcgcgaaggtataactactatacactcgtctttaccttttacctacccttcccgttcgttacttcgttacgggacctacgtccggaccccgtaccg

SEQ ID NO: 104507 - DNA, 772 bp, Homo sapiens
  misc_feature: GYAE6OF02HL7L0.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagtttcaagttgggtgcggacgggcctcgtggacaaggtccttgagtggagtgggaaggatcgtcctagtcgttgaccacaacctaaacgtacgcaacgaacgtaacgttccgaagggccaacgacctaccgaacctaacgtaaccggaccggtaaacctaaaagtttaaccgaaacctaacgtaacggtttaaactccggttaaggaacgtacgtaaggaaacctacgacccttaggtacctaacttcgtaacggtaacgggaaccgacgggtacctttaacgttaccgtttcgttacgggtacgaccggtaagggtaacgtttaaacttaacgttaaaacgtaaacctacgttaccggttaccttttaaccccgtttttaaccctacccccgttttacccgtttaacggttaacccgttttacccgggttaccggggttaccccgttaacgggtttaacccccggggtaaaccccccggtttcccgtaaccccgggtttacccccg

SEQ ID NO: 104508 - DNA, 716 bp, Homo sapiens
  misc_feature: GYAE6OF02JN3KL.17.34.D01.1.454.CMB.1.raw
  modified_base (333)..(333): a, c, t, g, unknown or other
  misc_feature (333)..(333): n is a, c, g, or t
  modified_base (386)..(386): a, c, t, g, unknown or other
  misc_feature (386)..(386): n is a, c, g, or t
  modified_base (532)..(532): a, c, t, g, unknown or other
  misc_feature (532)..(532): n is a, c, g, or t
tcagcgtagactagcacgaccggtgctcgatttagatcgtctgtgttgggtttggggtagtcacaaaacaaccagattcctcctctaaagaagcccctgggagcacagctcatcaccatggactggacctggaggttcctctttgtggtggcagcagctacacggtgtcctagtcccaggtccgtaggttggtgactaagtcgtggggtctgaggtagaaggacgcccgttgggtcccgtcgggtaggtacggggttccttcccgtagccgaagggtcctttcgtgggacgcctaccgttccgaagccgacgttataggtttacaagttgggngtcggaccgggtctcggtagtacgtaacggccttggagtggagtcggggaagntccggtcctagtcgtagaccacaccaaatcgactacgagtacgttcgagggctagacctacaccaagtacccggacgaactaaactacgaaccaacgtagtttaaatccgtaggatacgtagaacgtgaccttgtaccattaccgnggacggaaccggacggtcttaccgttacgttcctaggtcgtacggttaacggtaagttaaacttaacgtaactaacgtacccgtagttacccttttaccgttttaaccaacccccgtttccgtttaacgtccgtttaccggtccgggtacctaccgggttaccgggtaaaccccccggttccgg

SEQ ID NO: 104509 - DNA, 543 bp, Homo sapiens
  misc_feature: GYAE6OF02IK660.17.34.D01.1.454.CMB.1.raw
  modified_base (332)..(332): a, c, t, g, unknown or other
  misc_feature (332)..(332): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
tcagcgtagactagcacgaccggtgctcgatttagatcgtctgtgttgggtttggggatcacaaaacaaccagattcctcctctaaaagaagccccctgggagcacagctcatcaccatggactggacctggaggttcctctttgtggtggcagcagctacaggtgtccagtcccaggtccagttggtgcaatctggggctgaggtgaagacgcctgggtcctcggtgagggtcctcctgcaaggtcttcgtgggaggccaccttcagcgacttatagtttcaagttgggtgcgacgggcctcgtggacaaggccttgagtggatgggaagntcgtcctatcgtgacacacaactcgcacagacgtcaggcagactcacataccngaacaataacgacacatancgtgancagacacgctgtacactcgagacggacgacggtcttctacttctgtcgacgtagagttaattactanacnctgtccttacctttacacccttccttagtactttcggcggtcctagtcccggacccgtacccg

SEQ ID NO: 104510 - DNA, 580 bp, Homo sapiens
  misc_feature: GYAE6OF02FQP37.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccaggcagactcaccataaccgcgaacaaataacgaacacagttaatctaggagctagaacagccttagtacatcgtgagacgacggtcttactacttctgtcgacgagtagttaattactatacactcgtccttaccttttacctaccctttcccgtttacgtacctttccggttacggggtaccctacggttacccgggtaaccccggttacccg

SEQ ID NO: 104511 - DNA, 820 bp, Homo sapiens
  misc_feature: GYAE6OF02IVMKB.17.34.D01.1.454.CMB.1.raw
  modified_base (264)..(264): a, c, t, g, unknown or other
  misc_feature (264)..(264): n is a, c, g, or t
tcagcgtagactagcacgaccggtgctcgattttagatcgtctgtggttgggttgggatcacaaacaaccagtattcctcctctaaagaagccccgtacgggagcacacgctcactcaccatggactggacctggacgttctctttgtggtggcagcagctacgaggtgtccagtcccaggtcctagttggtgcaagtcgtggggctggaggtgaagacgccgtgggtcctcgggtgagggttcctcgtgacgaaggtcttcgngggacggcctaccttcgacgccgtaacttagttacgtttactaaggttggggtcgacggacgggtcctcgtaggtaaccgtaaggtccctttggaagggttgggacggttgggggaaacggtcgttcccggttacccttagttaccggtttacggaaccgtaaccgtaaaccccgaaacgttaccggacgaaccggttaaacgggtaaccggttacccggaacgggttaccgaaacggttaaccctacccgaaacccgtaaccggtaaaaccccgggtaccgggtaaaacctaaaaccggtttaaaccggaaacctaaaccggtttaaacgtttaacgtaccgggttaagggtaacgtaacgtaacgtaaaccgtacgttaccgttagtaccgtacgtaccgtagggaccgtaacggtcggtactttccgtacgtttccgtggtacgacgtaagtagttaacgtactaactactacgttacgttctttaccgtttacctaccgtccgtttagtaccgttcggtacggtacctacggttacccggtacccgtacccg

SEQ ID NO: 104512 - DNA, 606 bp, Homo sapiens
  misc_feature: GYAE6OF02GBHOZ.17.34.D01.1.454.CMB.1.raw
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgacgggtctcctgcaaggcttcgtggacggcaccttcagcgactatagtttcaagttggtgcgacggtcctntggacaggtccttgagtggatgggaagctcgtcctatcgtgacacacaacncgacacagactcgaggcagctacgacataaccgngaactaataacgaanaactaattaatcgtaganactagaacncggactgtacatcgtagacggtacacgggtcttaacgttctacgttggtacggacgtaagtaaacgttaacgtttactaacgtactactacggttaccctttaccttttaccgtaacccttacccttagtacccgtttacggttccgggaccctaccgggttacccggtaccccgttaccc

SEQ ID NO: 104513 - DNA, 618 bp, Homo sapiens
  misc_feature: GYAE6OF02ISMGP.17.34.D01.1.454.CMB.1.raw
  modified_base (258)..(258): a, c, t, g, unknown or other
  misc_feature (258)..(258): n is a, c, g, or t
  modified_base (326)..(326): a, c, t, g, unknown or other
  misc_feature (326)..(326): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaagcttctggagcaccttnagcgactatagtttcaattgggtgcggacgggcctcgtggacaaggtccttgaggtggagtgggaagntcgtccctagtcgtgacacaaccaaactcgcaacagaacgttccgaaggcagactcaccataaccgcgaacaaataacaacacaagttaactcgtagagtctagaacacgctgacatctagaggacgacggtcttacctacgttctgtacgtacggtaggtaagttaattaacgtaataacctacgtcgttacctttacccgtttttaacctacccgtttaccccgtttacgtcccgttttacggtacccggggttaccttaccggtacccgggtaacccccggttaccccg

SEQ ID NO: 104514 - DNA, 563 bp, Homo sapiens
  misc_feature: GYAE6OF02IENG0.17.34.D01.1.454.CMB.1.raw
  modified_base (139)..(139): a, c, t, g, unknown or other
  misc_feature (139)..(139): n is a, c, g, or t
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctntttgtggtggcagcagctacaggtgtccagtcccaggtccagttggtgcaatcgtggggttnaggtgaagacgcctgggtcctggtgagggtctcctgcaaggcttgnggaggcaccttnagcgactatagtttcaagttgggngcggacgggcctcgtggacaaggtccttgacgtgggatggggaagtntcgtcctagtcgttgacacacaactcgcacagatccgaggcagactcacataccgngaacaataacacanagtatctaganctagacncgctgtacatctagacgtacgtacgggtttctacgttctagtcgcggagtaagttaactataactaactctagtaccttacttttaaccaccttcctgttacttcgtcggacctacggtaccggtaacccgtccgtaccgttccg

SEQ ID NO: 104515 - DNA, 621 bp, Homo sapiens
  misc_feature: GYAE6OF02JHEX3.17.34.D01.1.454.CMB.1.raw
  modified_base (382)..(382): a, c, t, g, unknown or other
  misc_feature (382)..(382): n is a, c, g, or t
  modified_base (496)..(496): a, c, t, g, unknown or other
  misc_feature (496)..(496): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctcccgtcccccttgcagtaacaccaagtacaggaatattaacctgttcccatcgactacgcctttcggcctcgccttaggggtcgactcaccctgccccgattaacgtggacaggacccttggtccttccggcgagcgggcttttcacccgtntttactcgttacttatcgtcagctattcgctacttctgtataccctccagccatcgccctcacagccactaccttcacacggcttacgagaccgcctaccccacccaacaaccncaataacgccgtcgcctcgcccgccacgtccgttcggtcgtcacgtttcgggtttaccgtccccgttttctaccttccgttcccccgtacctacttccgttacgtaccgttacgtccgttaccgg

SEQ ID NO: 104516 - DNA, 564 bp, Homo sapiens
  misc_feature: GYAE6OF02H6ICA.17.34.D01.1.454.CMB.1.raw
  modified_base (283)..(283): a, c, t, g, unknown or other
  misc_feature (283)..(283): n is a, c, g, or t
  modified_base (335)..(335): a, c, t, g, unknown or other
  misc_feature (335)..(335): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagagcctggggcctcagtgaaggtctcctgcaaggcttctggattcacgtttacctcctatagtatcaaactgggtncgccaggccgctggacaacgacctgagtggatgggatgggacgaaccctaanacgtggtgtcacagtgtcttcacccatccgtccgggacacgtacttacatcgaccacgactctcaataacncanctacatggagttgaggancctgacatctgacgaccgacggccttcttaattcgtcgtggacgtaagtcgtacccacgacgttccgggtagaccggaccgtaccggcgacggtcccggtcctttacggtaccgtttcggtcggggcctaaccgggg

SEQ ID NO: 104517 - DNA, 625 bp, Homo sapiens
  misc_feature: GYAE6OF02JYELW.17.34.D01.1.454.CMB.1.raw
  modified_base (263)..(263): a, c, t, g, unknown or other
  misc_feature (263)..(263): n is a, c, g, or t
  modified_base (463)..(463): a, c, t, g, unknown or other
  misc_feature (463)..(463): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtcctcctgcaaggcttcgtggaggccaaccttnagcgtactattagtttcaatttggggtagcggacggggcctcgtggaacaaggtccttggacgtgagtgggaaggtatccgtcctagtccgtgacacaaccaaactcgcacgagtaacgttccgaggcaggactcaccacgtaaccgcggaactaaactaacgaactacgacgttaagcgtaggacgacgtagaaaccgngccttagactatacgagacggtacgacggtacttactacgttcgtagtcgacgtaggtaagtaacttacgtactacagttcgtacctttaccttttacgaaccctttccgtacgttccgttacggtccgggtaccctacgttacccgggtaccccgtacccg

SEQ ID NO: 104518 - DNA, 558 bp, Homo sapiens
  misc_feature: GYAE6OF02JF9UJ.17.34.D01.1.454.CMB.1.raw
  modified_base (282)..(282): a, c, t, g, unknown or other
  misc_feature (282)..(282): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattggggtncgacgggccctctggacaaggccttggagtggagtgggaaggatcgtccctatcgttgacacaccaactacgcacagaacgttccagggcagactcacataaccgcgacaaataacgaacacagttaatcgtaggagctagaacagcctgtcatctgagacgacggcttctacttctgtgacgagtagtaatactatactactcgtcttccgttttacaccttccgtgtaccgttcgtcgggtcctacgtaccggtacccgtccgtacccgttccg

SEQ ID NO: 104519 - DNA, 560 bp, Homo sapiens
  misc_feature: GYAE6OF02IYC33.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggagtgggaaggatcgtcctatcgttgacacaccaaacctacgcacagaagttccagggcagactcaccataaccgcgaacaaataacgaacacagttaatcgtagagctagaaccagcctgtcatctgaggacgacggtcttcttacttcgtgtgcgaggtagtaattacgtatactactcgtctttaccttttactaccttccttacgtactttcgtcgggacctacgtccggtaccccggtaccg

SEQ ID NO: 104520 - DNA, 537 bp, Homo sapiens
  misc_feature: GYAE6OF02FQOUM.17.34.D01.1.454.CMB.1.raw
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcgtggaggcaccttcagcgactatagtttcaagttgggtgcgacgggcctcgtggacaaggccttgagtggatgggaagntcgtcctatcgtnacacacaactcgcanagatcaggcagactcacanaccgcgaacaataacacacatatctaganctagaacacgctgtcatcgtagacggacgacggtctactacttctgtcgacgagtagtaattactactactactacgtcttaccttttacctaccttccttcgtacttcgtcggtactacgtccggacccgtccg

SEQ ID NO: 104521 - DNA, 563 bp, Homo sapiens
  misc_feature: GYAE6OF02IN4EZ.17.34.D01.1.454.CMB.1.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtnaagacgcctgggtcctcggtgagggtctcctgcaaggcttctggaggcaccttcagcgactagtagtttcaattgggtncggacggctctggacaggcctgagtgatgggaagntcgtcctatcgtgacanaccaatcgcacagtaacgttcaggcagactcacataacgcganaaacttacgacagataatctagganctagaacagctgacatcgngagacacggtcttactacttcgtagtcgacgagtaagttaacttacgtaacgtaactacgttcgtacctttaccgttttaacacccgttcccttgtaaccgtttcgacgggtccaagttaccggaaccccgttcaccgttccc

SEQ ID NO: 104522 - DNA, 595 bp, Homo sapiens
  misc_feature: GYAE6OF02H6Q50.17.34.D01.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (358)..(358): a, c, t, g, unknown or other
  misc_feature (358)..(358): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttttgtggtggcagcagctacaggtgtccagtcccaggtccagttggtgcaatctggggctgaggtgaagacgcctgggtcctcggtgagggtctcctgcaaggcttntggaggccaccttcagcgactattagttcaattgggtgcgacgggcctgtggacaaggccttgagtggagtgggaagntcgtcctatcgtgacacaccaaactaccgcaanagaagttccagggcagctcacataaccgcgacaaataacgaacacagttaatcgtaggagctagaacagcctagtcatctggacgacgacgggtccttacgttacttctggtcgacggaggtagtaattaacgtaactaacctacgtcggtacctttaccctttttaaccaccctttaccccttcgttaccttaccggttcggggtaccctacggttacccggtaccccgttacccg

SEQ ID NO: 104523 - DNA, 584 bp, Homo sapiens
  misc_feature: GYAE6OF02G9L6U.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcgtggaggcaccttcagcgactatagtttcaattgggtgcgacgggccctctggacaaggccttgagtggatgggaaggatcgtccctatcgttgacacaccaaaactcgcacagaatccagggcagactcacataaccgcgacaaataacgaacacagtaatcagagctagaacagcctgtactatcgtgaaggacacgggtcttactacctttcgtagtgacgtaggtagttaacgttaactaataacacgtagtccttaccgtttttaaccacccttcccttgtacctttacgtcgggtacctacgttaccgggaaccccggttcgacccgttacccg

SEQ ID NO: 104524 - DNA, 555 bp, Homo sapiens
  misc_feature: GYAE6OF02FIWCV.17.34.D01.1.454.CMB.1.raw
  modified_base (247)..(247): a, c, t, g, unknown or other
  misc_feature (247)..(247): n is a, c, g, or t
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggcaccttcagcgactatagtttcaagttgggtgcgacgggcctcgtggacaaggccttgagtggatgggaagntcgtcctatcgtgacacaccaaactcgcacagaacgttccgaggcagactcaccataaccgcgaacaaataacgaacacagtaatcgtaggagctagaacacgcctgtactatctgacggacgacggtcttactacttctgtcgcgagtagtaatactatacactcgtcttaccttttaccacccttaccttacgtacttcgtacgggtcctacgtaccggtacccgtacc

SEQ ID NO: 104525 - DNA, 537 bp, Homo sapiens
  misc_feature: GYAE6OF02GCHK7.17.34.D01.1.454.CMB.1.raw
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtgggggcaccttcagcgactatagtttcaattgggtgcgacgggcctctggacaaggccttgagtggatgggaaggatcgtcctatcgttgacacaccaaactacgcacagaagtccagggcagactcaccataccgcgacaaattacgaacacagtaatctgganctagaacagcctgtcatcngagacacgggtcttctacttctgtgcgagtagtaattactataacactgtcttcctttacaccttcccttgtacttcgtcggcctagtcggtacccgtctacccg

SEQ ID NO: 104526 - DNA, 612 bp, Homo sapiens
  misc_feature: GYAE6OF02I1PDI.17.34.D01.1.454.CMB.1.raw
  modified_base (245)..(245): a, c, t, g, unknown or other
  misc_feature (245)..(245): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggtctcctgcaggcttcnggagcaccttcagcgactatagtttcaattgggtgcgacgggcctcgtggacaaggccttggagtggatgggaagatcgtcctatcgttgacacaccaaactcgcacagacgttcaggcagactcaccataaccgcgaacaattaacgaacacaagttaatctaggagctagaacagccttagtccgtatctagacgacgacgggtcttaccgttacttcgtagtcgtacggtaaggtacgttaaacttacgttaacgtaacctacgttacgtaaccgtttaccctttttaaccgaacccgtttcccgtttacggttaccctttcggttaccgggcctaacggttaccggtaacccccggttacccg

SEQ ID NO: 104527 - DNA, 554 bp, Homo sapiens
  misc_feature: GYAE6OF02FP749.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggatcgtccctatcgttgacacaccaaactacgcacagaacgtccagggcagactcaccataaccgacgacaaataacgaacacaagtaatctggagctagaacagcctgcatctgaggacacgggtcttactacttctgtgacgaggtagtaattactactacactcgtcttaccttttaccacccttccgttacgtacttcgtcgggtcctacgtaccggaccccgtaccg

SEQ ID NO: 104528 - DNA, 605 bp, Homo sapiens
  misc_feature: GYAE6OF02FT1QW.17.34.D01.1.454.CMB.1.raw
  modified_base (324)..(324): a, c, t, g, unknown or other
  misc_feature (324)..(324): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagtttcaattgggtgcgacgggcctcgtggacaaggccttgagtggatgggaagntcgtcctatcgttgacacaccaaactacgcacagagttccagggcagactcacacgtaaccgcgaacaaataacgaacacagtaatctaggagctagaacagccttgtactatctagacggacgacgggtccttacttactttcgtgtcgacgaaggtagttaaagttaacttaactaactacgtacgtcctttacccgtttttaccctaccctttacccgtttcgtaccgtttccggttacggggtaccctacggttacccgggtacccccggttacccg

SEQ ID NO: 104529 - DNA, 550 bp, Homo sapiens
  misc_feature: GYAE6OF02FR75D.17.34.D01.1.454.CMB.1.raw
  modified_base (256)..(256): a, c, t, g, unknown or other
  misc_feature (256)..(256): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtgcgacgggcctctggacaaggccttgagtggatgggaagatcgtcctatcgttgacacaccaaactacgcacagaagtcagggcagactcacataaccgcggaacaaattaacgaacactaagttaatctaggagctagaacagcctgtacactctgaggacgacggtcttctacttcgtgtgacggtagtagtaatactaataacnctntcttaccttttacaccttcctcgtacttcgtcggtctacgtccggacccgtccaccgtccg

SEQ ID NO: 104530 - DNA, 559 bp, Homo sapiens
  misc_feature: GYAE6OF02IQVZL.17.34.D01.1.454.CMB.1.raw
  modified_base (412)..(412): a, c, t, g, unknown or other
  misc_feature (412)..(412): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattggtgcggacggcctctggacaaggccttggaggtggagtgggaagatcgtcctatcgttgacacaccaactacgacacaagaacgttccgagggcagactcaacataaccgcgaacaagtaacaacaacagttaanctagagctagaacagctagtcatctagagacgcggtcttactacttctgtcgacgaggtataattatatacactacgtctttaccttttactaccttacccttagtaccgtttcgtcgggtacctacgtaccggtaccccggtaccg

SEQ ID NO: 104531 - DNA, 608 bp, Homo sapiens
  misc_feature: GYAE6OF02I2IEV.17.34.D01.1.454.CMB.1.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
  modified_base (393)..(393): a, c, t, g, unknown or other
  misc_feature (393)..(393): n is a, c, g, or t
  modified_base (464)..(464): a, c, t, g, unknown or other
  misc_feature (464)..(464): n is a, c, g, or t
tcagcgtagactagcacgaccggtgctcgatttagatcgtctgtgttgggtttggggatcacaaaacaaccagattcctcctctaaagaagcccctgggagcacagctcatcacatggactggacctggaggttctcttgtggtggcagcagctacaggtgtccagtcccaggtccagttgtgcatctgggctgtacggtgaagaccgcctgggtcctcggtcgaggtctcgtgcaggcttcgnggagcnctcagctactatagttcagttggncgacggctgtagacaggctgagtggagtggagtntcgtctatcgtagacacaacaactcgacacgagtacgtacgaggcagtactcaacataaccgagaacaataacaacacagtaacngtagagtactagaacacgactagtactatcgtagacggacgacgggtaccttacgtacttacgtaggtacnggtacggtaacggtaacgttaactttaacgttaacttaaacctaacctaccgttaccgtttaacccgttttaacccgttaacccgttacccgtttaccggttaaccgtttaccggtttaccgggtaccggtaaccgttaaccgg

SEQ ID NO: 104532 - DNA, 711 bp, Homo sapiens
  misc_feature: GYAE6OF02H9365.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactactagtttcaagttgggtgcggacgggcctcgtacggacaacgggcctttggagtggagtagggaggatccgtcctatcgttagacaccaaccaaactacgcacagaacgttaccagggcagtactacaccacgtaaccgcggaactaaacgtaaacgaactaactaagttaaactcgtaggagacgtaagaacgaacgtccttacgtacctacgtacgtaggaacggtaaccgaccgggttcctttaaccgtttaccgtttccgtacggtttcggaacgggttaacgggtaacgttaaaacgtttaaccgttaactaaacctaccgtttacggtaacccttttaaccctttttaacccgttacccctttaccccgtttagttacccgttttccggtaccggggttaccctaacggttacccgggtaaccccccggttaccccgg

SEQ ID NO: 104533 - DNA, 611 bp, Homo sapiens
  misc_feature: GYAE6OF02JTM7F.17.34.D01.1.454.CMB.1.raw
  modified_base (324)..(324): a, c, t, g, unknown or other
  misc_feature (324)..(324): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcaaggcttcgtggaggcaccttcagcgactatagttcaagttgggtgcgacgggctgtggacaaggccttgagtggagtgggaagntcgtcctatcgtgacacacaactcgacacagacgtcaggcagactcacacgtaccgngaacaataacgaacacaagttaaacncgtaggagactagaaacacgtccgtacgtacactcgtaggacggtactaccgggtctttacctagttctaggtcgacggtaaagtacggttaaactttacgaattacctaacgttcgtaccgttttaaccgttttactaaccccgtttcttacgttacctttccggttacgggaccctacggtttacccggtacccgttacccg

SEQ ID NO: 104534 - DNA, 577 bp, Homo sapiens
  misc_feature: GYAE6OF02JFJIU.17.34.D01.1.454.CMB.1.raw
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgagggcctcgtggacaaggccttgagtggatgggaagatcgtcctatcgtgacacaccaaactcgcacagaacgttccagggcagactcaccanaaccgcgacaaattaacgaacanagtaactcgtaggagtctagaacagacctgtcatcngacgacgtacggtcttacctactcgtgtgacggtaggacgttaattactaactactacgtacgttccttaccttttacacccttccgtttagtacctttcggtacgggtaccctacggttacccggtaccccggttaccg

SEQ ID NO: 104535 - DNA, 545 bp, Homo sapiens
  misc_feature: GYAE6OF02HWLJ9.17.34.D01.1.454.CMB.1.raw
  modified_base (259)..(259): a, c, t, g, unknown or other
  misc_feature (259)..(259): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttnagcgactatagtttcaattgggtgcgacgggctctggacaaggccttgagtggatgggaaggatcgtccctatcgttgacacaccaaactacgcacagaagttccagggcagactcaccataaacccgcggaacaaattaaacgaacaacaagttaaatctaggagactagaacagcctagtcaatctagaggacacgggcttactacttctgtgcgaggagtaattactataacactgcttccttttacaccttccctgacttcgtcggcatcggaccgtacccg

SEQ ID NO: 104536 - DNA, 664 bp, Homo sapiens
  misc_feature: GYAE6OF02HGJC0.17.34.D01.1.454.CMB.1.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggctcgtggaggcaccttcagcgactatagtttcaattgggtgcggacgggtcctcgtggacaaggccttgagtggagtgggaagntcgtcctgtcgtgacacaccaacgtacgcacagaacgttccagggacagactcaaccacgtaaccgacggaacaaacttaacgaacaacgtaagttaatacgtaggagtactaagaaccacgtccgttgtacctagttacgtggaacggtaaccgaccgggtactttaccttaccgtttcgtaggtcggtacggtaggttaaacgttaaacgtttacctaacgtaaccgtacgtttaccggttcctttacccgtttttaacctaccccttccccgtttacgttaccgtttaccggtcgggtaccccgttacgggtacccggtaaccccccggttacccg

SEQ ID NO: 104537 - DNA, 558 bp, Homo sapiens
  misc_feature: GYAE6OF02ITSWG.17.34.D01.1.454.CMB.1.raw
  modified_base (405)..(405): a, c, t, g, unknown or other
  misc_feature (405)..(405): n is a, c, g, or t
tcagcgtagactagcacgaccggtgctcgatttagatcgtctgtgttgggtttggggacaaaacaaccagattcctcctctaaagaagccccctgggagcacagctcatcaccatggactggacctggagttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcacataaccgcgaacaattaacgaacacataanctaggagctgaacagcctgtcatctgagacacggcttactacttcgtgtgcgagtagtaacttactaataacactagtcttaccgtttttaccaccttcccttgtacctttcgtcgggtccgtacgtccggtaaccccggtaccaccgttccc

SEQ ID NO: 104538 - DNA, 556 bp, Homo sapiens
  misc_feature: GYAE6OF02GKN38.17.34.D01.1.454.CMB.1.raw
  modified_base (326)..(326): a, c, t, g, unknown or other
  misc_feature (326)..(326): n is a, c, g, or t
  modified_base (471)..(471): a, c, t, g, unknown or other
  misc_feature (471)..(471): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaatttgggtgcggacgggcctctggacaaggccttgagtggatggggaagntcgtcctatcgttgacacaccaaactcgcaacagaacgttccagggcagactcaccataaccgcggaacaaataacgaacacagttaatcgtagagctagaacagcctagtcatcgtgacgacgacggcttactacttctgtcgngagtagtaattactatacactgtcttaccttttactacccttacctttacttcgtcgggtcctacgtcggtaccccgtctacccg

SEQ ID NO: 104539 - DNA, 760 bp, Homo sapiens
  misc_feature: GYAE6OF02FGANC.17.34.D01.1.454.CMB.1.raw
  modified_base (186)..(186): a, c, t, g, unknown or other
  misc_feature (186)..(186): n is a, c, g, or t
  modified_base (256)..(256): a, c, t, g, unknown or other
  misc_feature (256)..(256): n is a, c, g, or t
tcagcgtagactagcacgaccggtgctcgatttagatcgtctgtgttgggtttgggatcacaaaacaaccagattcctcctctaaagaacgcccctgggagcacagctcatcaccatggactggacctggacgttcctcttgtggtgcagcagctacaggtcgtccagtcccaggtccagttggtncaagtcgtgggctgaggtgaacgcgtcgtgggtcctcgggtgacggtcctccgtggactaggtcttacgnggacgcctaccgttgacgtctaacttagttacgtttcgaacggttttcggggcgaccggtaccggtcctcggtacgaaccgtaggtccgtttagacggttagggaacgtgggaaacgtcttcccgtacccgttaagttccggtaacaacccaacctaaacccgaaacgtcgactaacgaacggttaccgtaccggaacgtaccaacgtaactaacccgaaaccgtaaaccgtaacccggaacgtaaacctaaaacgtaacgaactacgtaagtaacgcgtagactacgtaacgacacgttcctacgtacgtacgtaccgacggtaaccggtccgttaccgttcttacgtttacgtagtacgtacgtaacgtaaagttaacttaaccgttaactaacgttacctaccgttcgtttaaccccctttacgttaaccccgttcccgtttacgtacggttacccggtcggtaacccgggtactacccggtaacccggtttcccgaaccc

SEQ ID NO: 104540 - DNA, 738 bp, Homo sapiens
  misc_feature: GYAE6OF02J3LKC.17.34.D01.1.454.CMB.1.raw
  modified_base (196)..(196): a, c, t, g, unknown or other
  misc_feature (196)..(196): n is a, c, g, or t
  modified_base (552)..(552): a, c, t, g, unknown or other
  misc_feature (552)..(552): n is a, c, g, or t
tcagcgtagactagcacgaccggtgctcgatttagatcgtctgtgttgggtttgggacaaacaaccagattcctcctactaaagaacgcccctgggagcacagctcatccaccagtggactggaccgtgggtacgtttccttctttggtggtggcagcagctacgaggtctccagtcccgaggtcctaggttggtnactagtcgtggggctggaggtagaacgccgtccggttcgggttccgtcgggtacgtcggttcctccgtggacgtacggtccttcggacgggtaccgcctaccgttacgacgtaccgtaacttagttacgttcgtaagtgggtcgccggacggtcctaggtacgacgtacgtccgtaggagtggagtgggaacgcttccgtcctagtccgtacgaaccacctaaccaacgtcgacgacgtcggtaacgtcgacggactaccgtacaccgacgtaaccgtaacccggtaacgaaaccgtaaactaaccgaacgtaacgtacgtacgtacggtagaccgtcgaacgacgtcgtaccgtnacgcgtacgtaggccgtacgtaccgtacttacgtcgttacgacgtagaaccgttagttaactacttaacgtacttactccgttacgttaccttttacccggtaacccttccgtacgttaccggtacccgttaggacccggttaccacccggttacccggtaccccgtttacccgcccgttaccccg

SEQ ID NO: 104541 - DNA, 570 bp, Homo sapiens
  misc_feature: GYAE6OF02GO9C5.17.34.D01.1.454.CMB.1.raw
  modified_base (285)..(285): a, c, t, g, unknown or other
  misc_feature (285)..(285): n is a, c, g, or t
  modified_base (422)..(422): a, c, t, g, unknown or other
  misc_feature (422)..(422): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttctgggaggcaccgttcagcgactatagtttcaattgggngcgacggcctcgtggacaaggtccttagagtggatgggaagatcgtcctatcgttgaccacaccaaactcgcacagtaacgtccgaggcagactcacataccgcgactaaataacgaacacgagttaagtctagganctagaacagcctgtacatctagagaccgtacgggtcttacgtacttctgtcgcgtaagagttaacttactatactcgtcgtccttaccttttactacccttccgttagtaccttcgtacgggtacctacgtaccggaccccgttaccg

SEQ ID NO: 104542 - DNA, 655 bp, Homo sapiens
  misc_feature: GYAE6OF02HUMZ9.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcggacgggctcgtggacaaggccttgagtggagtgggaagatcgtcctagtcgttgacacaccaaactacgcaacagaacgtccgaggcagactacaccaataacccgacggaactaaaattaaccgaactaacaacgttaaactcgtaggacgtacgtagaacgacgactacgtactactacgtacggaacgacgtacgggtacctttacgttacgtttcgtcgtacgcggtaaggtaagttaaacttaactaactaactacgtacgttacctttaccgtttttaacctacccctttccttacgtacccgtttaccggtacgggtaccgtaccgttacccgggtaaccccggttacccgtacccgttacccg

SEQ ID NO: 104543 - DNA, 610 bp, Homo sapiens
  misc_feature: GYAE6OF02H04IZ.17.34.D01.1.454.CMB.1.raw
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctcctggcaaggcttcgtggaggcacttcagcgacttatagttcaagttgggtgcggacgggcctgtaggacaggtccttggaggtggngtgggaagntcgtcctagtcgtgacacaccaactcgacacagactacgaggcagactcacataccgngaacaaatacgaanacagttaancgagagctagaacagctacgtanatacgaggaacggacgacgggtacttacgttaccgttacgtggtacggagtaacgggttaataaacgtttacgtaagttaccacgttcgtaccgttttaaccttttaccgtaccctttaccgttacgttaccgtttcggtacgggtaccctacgttacccgggaaccccgttccg

SEQ ID NO: 104544 - DNA, 636 bp, Homo sapiens
  misc_feature: GYAE6OF02JMORY.17.34.D01.1.454.CMB.1.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggncgacggcctntggacaaggtccttgaagtggagtggggaagactcggtccctatcggttagaccacaaccaaactcgcaacgagacgttccgagggccagtacctacaacccgtaataaccccggacggaactaaaagttaaaccgaactaacgtaagtttaaactcgtaggacgtactagaaccaggtcctagtacacgtctagtacggaccgtacgggtcttacttaccttgtacgtgacgtagtaagtaattacgttactacgtactcgtcctttaccgttttaccacccgtttccgttacgtaccgtttcggtaccggtacctacggttaccggaaccccgttacccg

SEQ ID NO: 104545 - DNA, 776 bp, Homo sapiens
  misc_feature: GYAE6OF02I5TR9.17.34.D01.1.454.CMB.1.raw
  modified_base (286)..(286): a, c, t, g, unknown or other
  misc_feature (286)..(286): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcccaatctggggctgaggtgaagacgcctgggtcctcggtgagggtctcctgcaaggcttctggaggcaccttcagcgactatacgtttcaattgggtnccggacgggtcctcgtggacaaggtcccttaggaggtgggacgtgggggaaaggtctcccggtcccttagtccgttagacaccaaccaaacctacgacaacagaacgttccgagggacacgacctaccaacctaagtaaaccccggacggtaaacctaaaacgttaaaccgaaacctaaccgtaacgtttaaacgtacgtacgggaacgtacgtaacggaaacctacggtaccgttacgtacctaacttccgtaaggtaaccgggaaccgtaccggggtccttttaccgtttacccgttcgttcggtggtaacggtaagggtaaacgtttaaacgttaacgttaaactaaccgttaccgtttcggtttaacccttttacccttttttaaccctaacccccgtttaccccgttttaccgttacccgttttaccggttacccggggttacccgtaaccgggttaccccgggttaaccccccggttaccccgg

SEQ ID NO: 104546 - DNA, 562 bp, Homo sapiens
  misc_feature: GYAE6OF02H64PB.17.34.D01.1.454.CMB.1.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcggacgggcctctggacaaggccttggagtggagtggggagntcgtcctatcgttgacacaaccaaactacgcacagaagttccagggcagactcaccataaccgcgaacaataacgaacacaagttaatctaggagctagaacagcctgtacatctgacggacacgggtcttactacttctgtgcgtaggataattactatacactgtcttccttttaacctaccctttccctttacttccgtcgggtcctacgttaccggtaccccggtctaccccg

SEQ ID NO: 104547 - DNA, 611 bp, Homo sapiens
  misc_feature: GYAE6OF02GOPI8.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtgggaggcaccttcagcgactatagtttcaattgggtgcgacgggcctcgtggacaaggtccttgagtggagtgggaagatcgtcctatcgttgacacaccaactacgcacgagtaacgttcgagggcagacctcaccagtaaccgacggaacaaataacgaacactaagttaactacgtagagacgtacgaacgacgctgtactagtcgtagacggacgacgggtcttaccgtacttcgtggtcgacgtaggtaagttaacttactaactaactactacgttactttacccttttacctacccttacccgttcgttaccgtttcggttacgggtaccgtacgttaccggtaccccgtacccg

SEQ ID NO: 104548 - DNA, 827 bp, Homo sapiens
  misc_feature: GYAE6OF02FET8R.17.34.D01.1.454.CMB.1.raw
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
tcagcgtagactagcacgaccggtgctcgatttagatcgtctgtgttgggtttggggacaaaacaccagattcctcctctaaagaagcccctgggagcacagctcatcaccatggactggacctggaggttcctctttgtggtggcagcagctacgaggtcgtccagtcccgaggtcctagttggtgcaatcgtggggctggaggtgaacgacgccgtgggtcctgggtgacgggtctcgtgcaaggcttcgtggacgcaccttnagcgtactatagttcaagttgggcnccggtacgggtccttcgtacggacaacggtccgtttaggagtgggaagtggggtaagctccgttaccgtagtcggttagaacccaaccgtaaacccgaaacttccggacctaacgtaacggtaccgttaccggaacggggtacaaccgggtaacctaccgaaaccgtaaaccgtaaacccggggacgggaaaaccttaaaacgttaaaccggaaactaaacgttaaggttaaactcggtaacgggtacgtacgtaacgtaaccgtaaccgtaccgtagttaccgtagtacggttacggaacggttaccggtacccggtttacgttaccgttaacgttccgttacggggttacggaacgggttaacggttaaacgttaaactttaaaccgtacgttaaccctaccggtttacttacccctttacccgttttttaaccccgaccccgtttacccgtttacgttacccggtttaccggtacccgggttaccgttaaccggttacccccgggtaccccggttccgtaaccccgttaccccg

SEQ ID NO: 104549 - DNA, 585 bp, Homo sapiens
  misc_feature: GYAE6OF02GQVHF.17.34.D01.1.454.CMB.1.raw
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtccccaggtccagttggtgcaatctggggctgaggtgaagacgcctgggtcctcgggtgagggtctcctgcaaggcttctggagcaccttnagcgactatagtttcaattgggngcgacgggcctctggacaaggccttgagtggatgggagtatcgtcctatcgttagacaacaccaaacgtacgcaacgagaacgttccagggcaagactcaccataccgngaacaataacgaacacataancgtaganctagaacagacctagtcactcgtagaggacgacggtcttacgtacttcgtgtcgacgtagtagttaacttacgtaatacacgtacgtcttaccttttaacctacccttaccgttactaccgtttccggtaccgggtaccctacggttaccggaccccgttaccgg

SEQ ID NO: 104550 - DNA, 564 bp, Homo sapiens
  misc_feature: GYAE6OF02GCZMA.17.34.D01.1.454.CMB.1.raw
  modified_base (324)..(324): a, c, t, g, unknown or other
  misc_feature (324)..(324): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcggacgggcctcgtggacaaggccttggaggtggagtgggaagntcgtcctatcgttgacacaccaactcgcacagagtccaggcagactcacataaccgcgaacaaacttaacgaacacaagttaactctaggagctagaacacgcctgtacactctaggagacgacggtcttactacttcgtgtcgngagtagtaattactactaacnctgtccttaccttttaccaccttacctcgtacttcgtcgggacctacgtccggtaaccccgtctacccgttccg

SEQ ID NO: 104551 - DNA, 658 bp, Homo sapiens
  misc_feature: GYAE6OF02JQK7P.17.34.D01.1.454.CMB.1.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
tcagcgtagactagcacgaccggtgctcgatttagatcgtctgtgttgggtttggggacaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctggcaaggtcttctggacggcaccgttnagcgactatagtttcaattgggtagcggacgggtcctntggacaaggccttgagtgatgggagatcgtcctatcgttnacacacgaaactcgcactagaagttccagggcagactcacataccgcgaacaaattacgaacactagttaanactagganactagaacacgtacctgtacacgttacgtacgacggactacgggtaccttcgttaaccgttctggtacgtacggtaacggtaagttaaacttaacgtattaaacctaacgtcgttaaccttttacccgtttttaaccctaacccgttttacccgtttacggttaacccgtttccgttaaccggggtacccctaacgttacccgggtaaccccccgggtttaccgtaccccggttaccccgg

SEQ ID NO: 104552 - DNA, 540 bp, Homo sapiens
  misc_feature: GYAE6OF02HWKLR.17.34.D01.1.454.CMB.1.raw
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagagcctgggtcctggtgagggtctcctgcaaaggcttctggaggcaccttcagcgactaatagtttcaaattgggtncgacgggcctctggacaagggccttgagtggatgggaagntcgtccctatcgttgacacaccaaaactacgcacanaagttccagggcagactcaccataaaccgnggacaaaataacgaacacagtaanctgagctnaacagccngtcatctgaggacagggcttctactactntgcgaggagtaattactaataacactgctccttttacaccttcccttagccttcgtagggccgaactcggaaccccgtccg

SEQ ID NO: 104553 - DNA, 555 bp, Homo sapiens
  misc_feature: GYAE6OF02FLTCQ.17.34.D01.1.454.CMB.1.raw
  modified_base (508)..(508): a, c, t, g, unknown or other
  misc_feature (508)..(508): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctcgtggacaaggccttgagtggatgggaagatcgtcctatcgttgacacaccaaactacgcacagaacgttcagggcagactcaccataccgcgaacaaataacgaacacaagttaatcgtaggacgctagaacagcctgtcatctagacgacgacggtcttactacgttctggtgcgagtagttaattactatacactcgtcttaccttttacncccttccttagtaccttcgtcggtacctacgtaccggtacccgtccg

SEQ ID NO: 104554 - DNA, 596 bp, Homo sapiens
  misc_feature: GYAE6OF02G94I2.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggcctctggacaaggccttgagtggatgggaaggatcgtcctatcgttgacacaccaaactcgcacagaagttccagggcagactcaccataccgcggaacaaattaaccgaacacaagttaatactaggagtctagaacagcctagtacactctagaggacgacggtacttctacttcgtgtcgtcggagtagttaacttaactaacgtaactactacgtcgttaccttttaaccaccctttacccttcgtaccgtttacgttccgggcctacgtacccgggtaaccccggttccgtacccgttacccg

SEQ ID NO: 104555 - DNA, 569 bp, Homo sapiens
  misc_feature: GYAE6OF02H2XLV.17.34.D01.1.454.CMB.1.raw
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
tcagcgtagactagcacgaccggtgctcgatttagatcgtctgtgttgggtttggggacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagttcaattgggtncgacgggctcgtggacaaggccttgagtggagtgggaaggtntccgtcctatcgttagacacaaccaaactacgcacagaatccgaggcagactcacaataaccgcgaacaaataacgaacagatangagagnacgaangctgtacatctagagacgngtactctattcgngtgacgagtattaactactaataactctgtacctttaccgttaacctccctttaccttacgtacctttaggccgggtaccacggttaccccgggtaacccggttccttacccggtaccc

SEQ ID NO: 104556 - DNA, 554 bp, Homo sapiens
  misc_feature: GYAE6OF02I7UGC.17.34.D01.1.454.CMB.1.raw
  modified_base (355)..(355): a, c, t, g, unknown or other
  misc_feature (355)..(355): n is a, c, g, or t
  modified_base (477)..(477): a, c, t, g, unknown or other
  misc_feature (477)..(477): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggtatcggtcccgatcgttcgacacacaaactcgcanagaattccaggcagactcaccataacccgcggacaaattaacgacacagttaatcagagctagaacagctgtcatcagacgacacggtcttcgtactctgtgcgagagttaatactataacnctagtcttccttttacacccttccttagtcctttcgtcgggtaccctagtccggtaccccggttactcccgttaccc

SEQ ID NO: 104557 - DNA, 620 bp, Homo sapiens
  misc_feature: GYAE6OF02GPFJY.17.34.D01.1.454.CMB.1.raw
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcaggcgactatagttcaagttgggtgcggacggcctcgtggacgaaggccttgagtggatgggaagntcgtcctatcgtanactacaccaaactcgcacagacgttccagggcacgactccaccataacccgcggaacaaacgttaaccgaactaactaaagttaaactcgtacggagtacgtagaaccgacgtccttagtacacgttctaggacggaccgacgggtcctttacgttacttaccgtgtcggacgtaacggtagttaaacttactaactactactcgtcctttaccttttacctacccttcccgttagtaccttcggtcgggtacctacggttaccggtaccccgttacccg

SEQ ID NO: 104558 - DNA, 783 bp, Homo sapiens
  misc_feature: GYAE6OF02HCSM9.17.34.D01.1.454.CMB.1.raw
tcagcgtagactagcacgaccggtgctcgatttagatcgtctgtgttgggtttggggatcacaaaacaaccagattcctcctctaaagaagccctgggagcacagctcatcacatggactggacctggaggttcctctttgtggtggcagcagctacaggtgtccagtcccaggtccagttggtgacaatcgtggggctgaggtgaagacgccgtgggtcctcggtgagggtctccgtgacgaaggtcttcgtgggaggccaccttcgagcggacttaagttagttcaagtttgggtacgcggtaccgggcctacgtgggaacaagggtccttaggagttagggacgtgggtaaaggactccggttacctaagttcggttagacccgtaacaacctaaaacggtccgacgtaaacgacgtaaacggttaccgaggggaccaacgggaaccttacccgaaacccgtaagtaaaccccgggtacgggaaactaaaaacgtttaaaccggaaaccgaacgttaaacgttaaactccgttaagggaactcggtaacgaaacgaccgtaccgttacggtacctaagttacctcggtaaacgggaccgtaccggggtactttaaccgttaccgtttacgttaccggtagaccgggtaggtaaagttaaaccgttaacttaactaaccgtacgttaccgtcctttaccttttacccgtaaccctttacccgttacggttcctttaccggtacgggtcccggtaacgttaccgggtaccccggttaacccg

SEQ ID NO: 104559 - DNA, 660 bp, Homo sapiens
  misc_feature: GYAE6OF02I4HID.17.34.D01.1.454.CMB.1.raw
  modified_base (260)..(260): a, c, t, g, unknown or other
  misc_feature (260)..(260): n is a, c, g, or t
  modified_base (335)..(335): a, c, t, g, unknown or other
  misc_feature (335)..(335): n is a, c, g, or t
  modified_base (426)..(426): a, c, t, g, unknown or other
  misc_feature (426)..(426): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggattcacgtttaccncctatagtatcaactgggtcgcgccaggcccgctggacaacgcctgacgtggagtgggatgggccgaaccctaanacgtggtcgtcacgagttgtcttcacccatcccgtccggacagacttacatgacccacgacctcctaccaataaaccacacgaccctaacncgtagggtacgttaggacggtacgcctacggactactcgtacggaccgaccgaccgggtccgttaccttaacttaccgttggtacggtcggaaacgtccggtaccccaacggtacgttcccgggtacgtaacggtccccggtaaccggcggtaaccgggtccgggttacccttttacgggtacccgtttccgggtaccgggggacccgtacgggggtacctaccccggttcggg

SEQ ID NO: 104560 - DNA, 579 bp, Homo sapiens
  misc_feature: GYAE6OF02HP5XY.17.34.D01.1.454.CMB.1.raw
  modified_base (326)..(326): a, c, t, g, unknown or other
  misc_feature (326)..(326): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcgggtgagggtctccgtgcaaggcttctggaggcacttcagcgactatagtttcaattgggtgcgacggcctctggacaaggccttgaggtggagtgggaaggntcgtcctatcgttcgacacaccaatacgcacagaacgttccaggcagactcaccataaccgcgaacaaactaacgaacaacaagttaactctaggagacagaacagacctgtcactcngacggacgacggtnttacttactctgtgcgaaggtaataagttaactataactacgtacgtcctttacccttttactacccttccctttacgtacctttcgtccgggtacctagtcccggtaaccccgttacccg

SEQ ID NO: 104561 - DNA, 670 bp, Homo sapiens
  misc_feature: GYAE6OF02IIHVR.17.34.D01.1.454.CMB.1.raw
  modified_base (219)..(219): a, c, t, g, unknown or other
  misc_feature (219)..(219): n is a, c, g, or t
  modified_base (360)..(360): a, c, t, g, unknown or other
  misc_feature (360)..(360): n is a, c, g, or t
  modified_base (447)..(447): a, c, t, g, unknown or other
  misc_feature (447)..(447): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaagtgcccactcccaggtgcagctggtgcagtcgtggggctgaggtgaagagccgtgggcctnagtgaaggtctccgtgcaaggtcttcgtggattctacgttttacctctatagtatacaacgttgggcgcgccgaggccgcgtaggaccaacggtacctggaggtggacgtgggatcggggaaccaaaccctaagcgtggtntacgaactgttcgtcttaccaccctatcccgtcgggaacacgtaaccttaccatcgaacccgacgtaacctcctaccaaataaaccnccacgtaccctaagaagttgggtaaacgttggaacgggtaaccgccgttaggaaacctaagttccgtacgaaaccggaccgtaacccgggtcccttaagtttaactaccggttgcgaccggtaacgtacgttaccccagtccgtaccgggtagaaccgtcccgtaaccggacgtacggtcccgttcgtttacgtaccgtttcggtacggggccctaacggggg

SEQ ID NO: 104562 - DNA, 560 bp, Homo sapiens
  misc_feature: GYAE6OF02HDZAV.17.34.D01.1.454.CMB.1.raw
  modified_base (323)..(323): a, c, t, g, unknown or other
  misc_feature (323)..(323): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (484)..(484): a, c, t, g, unknown or other
  misc_feature (484)..(484): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtcctatcgttgacacaccaaactacgcacagaagttccagggcagactcaccataaccgcggaacaaattaacgaacacagttaatcgtagganctagaacagcctagtcatctagagacacgggcttctacttcngtgngaggataattactatacncttcgctttacccttttactacccttcccttagtacctttcgtccgggtcctaacgttccggtacccccgtacccg

SEQ ID NO: 104563 - DNA, 696 bp, Homo sapiens
  misc_feature: GYAE6OF02JNUTD.17.34.D01.1.454.CMB.1.raw
  modified_base (247)..(247): a, c, t, g, unknown or other
  misc_feature (247)..(247): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagcgccgtgggtcctcggtgagggtctccgtgcaaggcttcgnggaggcaccttcagcgactatagtttcaattgggtgccggacggcctgtggacaaggtccttggagtggatgggaagatcgtcctatcgtgacacaaccaactcgcacgagtaacgttccgagggcaagactacaccaacgtaaccgcggaaactaaaacgttaaccgaaactaacgaacgtttaactacgttacggaacgacgtaacggaaactacgtaccctaggtacctaagtacctaacgggaacggtaacgtaccgggtacctttaccgttaacgttaccgttggtaccggtacggtaagggtaactttaaacgttaactaaagtaaccgttacgtacgttacctttacccgtttttaaccacccgtttaccgttcgttaccgttacggttaccggggaccttacggttacccgggtaaccccgttaccgtacccggttacccg

SEQ ID NO: 104564 - DNA, 696 bp, Homo sapiens
  misc_feature: GYAE6OF02JZGP4.17.34.D01.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (316)..(316): a, c, t, g, unknown or other
  misc_feature (316)..(316): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggcttcgnggaggcacttcgagcgactatagtttcaattgggtncggacgggcctcgtggacagtctgagtgagtggagntcgtcctagtctgacacgtaaccaaactcgacacgagtaacgttccgaggtacacgtaccgtcaacccgtaataacccggacggaacctaaactttaaccgaaccaacgtacgttaaactacggtacggaacgtactacgaaccgtacgaccgtacgtaccaattaccgtagggtacggaaaccgtaccggggtcctttacgtaactttacgtggtacggtaccgaagggttaagttaaccttaaagtaacctaaacttccgtacgttacctttacccgtttttaaccacccgttttacccgttacgttaaccggttttcccgtacggggtacccttaaccggttcccggtaaccccggttaccgtacccggttaccccg

SEQ ID NO: 104565 - DNA, 612 bp, Homo sapiens
  misc_feature: GYAE6OF02FYBV0.17.34.D01.1.454.CMB.1.raw
  modified_base (281)..(281): a, c, t, g, unknown or other
  misc_feature (281)..(281): n is a, c, g, or t
  modified_base (323)..(323): a, c, t, g, unknown or other
  misc_feature (323)..(323): n is a, c, g, or t
  modified_base (390)..(390): a, c, t, g, unknown or other
  misc_feature (390)..(390): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatacgtttcaattgggtncgacggcctcgtggacaaggccttgaggtggagtgggaaggntcgtccctagtcgttgacacaccaactacgcacagaagtccgaggcagactcaccataaccgcgaanaaactaacgaacacagtaactctaggagtcgtagaacacgtcctcgtacatcgtagaacggacctaccgggtccttccttacgttctgtcgtcggtaacggtagttaacttaactaactaaccgtacttcgtcctttaccgtttttaaccaccctttcccttacgttaccgttcggtacgggtcctacggtaccggtaacccccggttcgacccgttacccg

SEQ ID NO: 104566 - DNA, 574 bp, Homo sapiens
  misc_feature: GYAE6OF02FLY2B.17.34.D01.1.454.CMB.1.raw
  modified_base (320)..(320): a, c, t, g, unknown or other
  misc_feature (320)..(320): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctctggacaaggccttgagtggatgggaagntcgtcctatcgttgacacaccaaactcgcacagaattccaggcagactcaccactaaccgcggaacaaacttaacgaacacaagttaactctaggagctagaacagacctgtacatctgacgacacggtcttctacttctgtgcgagtagttaattactagtaacacgttcgtactttcccgttttaactacccttcccttagtacctttcgtcgggtcctacgtaccggtaaccccggttcgtacccgttccg

SEQ ID NO: 104567 - DNA, 623 bp, Homo sapiens
  misc_feature: GYAE6OF02HB0F1.17.34.D01.1.454.CMB.1.raw
  modified_base (321)..(321): a, c, t, g, unknown or other
  misc_feature (321)..(321): n is a, c, g, or t
  modified_base (422)..(422): a, c, t, g, unknown or other
  misc_feature (422)..(422): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcaaggcttcgtggaggcaccttcagcgactatagtttcaagttggtgcgacgggctctggacaaggccttgagtggagtgggaagntcgtcctagtcgttgacacaccaaatcgcacagtacgtcgagggcagactcacaatacgcggaaacaaacgttaacgaacacgtagtaaactcgtaggganactagtaaacacgccctagtctatcgtacgacggaccgtacggtccgttacttaccttgtacgtcgacggtaacgttagttaaactttaacgtaacttaaccgacttcgttacctttaccgttttaaccacccgtttcctacgttaccgttcggtacgggtacctacgtttacccgggaaccccgttccgtacccgttccc

SEQ ID NO: 104568 - DNA, 710 bp, Homo sapiens
  misc_feature: GYAE6OF02H924K.17.34.D01.1.454.CMB.1.raw
tcagcgtagactagcacgaccggtgctcgatttagatcgtctgtgttgggtttggggatcacaaaacaaccagattccctcctctaaagaagcccctgggagcacagctcatcaccatggactggacctggaggttcctctttgtggtggcagcagctacgaggtgtccagtcccaggtccaggttggtgacaatcgtgggctgaggtgaagacgcgtgggtcctggtgagggtctcgtgacaaggtcttcgtgggagcctaccttcgagcgtacttatagtttacaagtttgggagacggaccgggcctgtacggaactaacggtcctttaggacggtaggaggttaggggaacggtacgttcccgtaccttagtaccggttagaaccaccaacctaaactacgacaaccgaagtacgttaccgaagggaccaacgacctaccaacgtaaccgtaaccggaacggaaacctaaacgtaaccgaacaacgtaagttaacacgtaggtacgtactaagacgacgtcctagtacagttcgaggacggtaccgtacggttcttaccgttacttccgtaggtcggtacgtaggtaaactaaacgtttaagtaaccgtaacctcgttaccgttacccttttacccttttaccaccccgtttaccttcgtaccgttcggtccggtaccgtaccggtacccggtaccccgttacccg

SEQ ID NO: 104569 - DNA, 613 bp, Homo sapiens
  misc_feature: GYAE6OF02JJEHY.17.34.D01.1.454.CMB.1.raw
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattggggtgcgacgggcctcgtggacaggccttgagtggatgggaagatccgtcctatcgtgacacaccaaactcgcacagaacgttccgaggcagactcacataccgngaacaaataacgaacanacgttaatcgtaggagactacgaacacgccgtagtacacgtctagaacggaccgacgggtcctttaccgttacgttacctgtacggtacgaagggtacgttaaattacgtaatacgtactcggtaccttttacccttttaaccgtaccctttacccgttaggttacccgttccggtaccgggtacctacggtaccggtaccccggttacccg

SEQ ID NO: 104570 - DNA, 658 bp, Homo sapiens
  misc_feature: GYAE6OF02I9PZX.17.34.D01.1.454.CMB.1.raw
  modified_base (365)..(365): a, c, t, g, unknown or other
  misc_feature (365)..(365): n is a, c, g, or t
  modified_base (428)..(428): a, c, t, g, unknown or other
  misc_feature (428)..(428): n is a, c, g, or t
  modified_base (465)..(465): a, c, t, g, unknown or other
  misc_feature (465)..(465): n is a, c, g, or t
  modified_base (546)..(546): a, c, t, g, unknown or other
  misc_feature (546)..(546): n is a, c, g, or t
  modified_base (579)..(579): a, c, t, g, unknown or other
  misc_feature (579)..(579): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaaacatagccttctccgtccccccttgcagtaacaccaagtacaggaatattaacctgtttaccccatcgactacgcctttcggcctcgcttacgggtcactcaccctgccccgtattaacgtggacaggaacccttggtcctccggngacgcggcttttcaccgtcttatcgttactatgtcagtcattcgctacttcagactcctaccngtacgctacgccctacacacgctaacctacctcaacncggacttacacgaaccgccctacccctaccgaaaccaaccgctaactaacgtccgaccgtcacgccgcacgtcgttaccgngacctagttcgggttaaccctcccccggttttnaacccgtttcccgttttacccccgacccgtacgtttaccccgtacgggttaaccctttacggttaccccgttaacccgg

SEQ ID NO: 104571 - DNA, 629 bp, Homo sapiens
  misc_feature: GYAE6OF02HZA90.17.34.D01.1.454.CMB.1.raw
  modified_base (249)..(249): a, c, t, g, unknown or other
  misc_feature (249)..(249): n is a, c, g, or t
tcagcgtagactagcacgaccggtgctcgatttagatcgtctgtgttgggtttgggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcgaaggcttcgnggaggcaccttcagcgactatagttcaagttgggtgcggacgggcctcgtggacaaggccttgagtggagtgggaagctcgtcctagtcgttgacacaccaactcgcacagagtccaggcagactcacataccgcgaacaaacgtaacgaacactagtaatcgtaggatacgtagaacgtacgacctgtacacgttcgtaggacggacgtacgggtccttacgttacctttcgtggtcggtacggtaacgggtaagtaaacgttacttaacgtaacgtacgttacggttacctttaccctttttaccgtaaccccgtttcccttacgttaccgttccggttccgggtacccgtacggttacccggtacccccggtacccg

SEQ ID NO: 104572 - DNA, 538 bp, Homo sapiens
  misc_feature: GYAE6OF02GXOKD.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtcctatcgttgacacacaaactacgcacagaagttccaggcagactcacataccgcgaacaaataacgaacacaagttaatcgtaggagactagaacagcctgtacatctagagacgacggcttactacttctgtgcgagagtaatactatacactgtcttaccttttacaccttccttgtacttcgtcgggacctacgtccggacccgtccg

SEQ ID NO: 104573 - DNA, 712 bp, Homo sapiens
  misc_feature: GYAE6OF02I71J6.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacaggtgtccagtcccaggtccaggttggtgcaatcgtggggctgaggtgaagacgcgtgggtcctcgggtgagggtctccgtgcgaaggcttcgtggaggctaccttcagcgactagtagtttcaagttgggtgccgacgggtcctcgtggacaaggtccttggaggtggagtagggaaggtactcgtcctagtcgtgacacacaaacgtcgacaacgagaacttcgagggaacacggtactacaaccgaacgtaaccggaccggtaaactaaaagttaaccgaacgtaactaacgttaactacgtaggaacgacgtacgaaacgtacgtacgtacgtacgtaactacgtagaacgggtaacgtaccgggtacctttacgttaaccgtttcgtacggttcgtaacggtaacggttaacgttaaacgttaacgttaacgtaaacgtaccgttacgttactttacccgttttacacccgtttacccttacgttaccgtttcgtaccgggttacccgtaacggttacccggtaacccggttaccgtacccgttaccccg

SEQ ID NO: 104574 - DNA, 582 bp, Homo sapiens
  misc_feature: GYAE6OF02HR08F.17.34.D01.1.454.CMB.1.raw
  modified_base (323)..(323): a, c, t, g, unknown or other
  misc_feature (323)..(323): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttggtgcgacggcctctggacaaggccttgagtggagtgggaaggntcgtcctatcgtgacacaccaaactacgacacagtaagtccgaggcagactcaccactaccgagaacaaataacgaactaacagttaactcgtaggancgtagaacncgctgtacattcngacggacacggtcttacctacttctgtgacgtaggtaattaacttactaatactactacgtctttacccttttaccaccctttaccgttgttacccgttcggtccggtaccgtaccgttacccggtaccccgttacccg

SEQ ID NO: 104575 - DNA, 756 bp, Homo sapiens
  misc_feature: GYAE6OF02JLTEC.17.34.D01.1.454.CMB.1.raw
  modified_base (280)..(280): a, c, t, g, unknown or other
  misc_feature (280)..(280): n is a, c, g, or t
tcagcgtagactagcacgaccggtgctcgatttagatcgtctgtgttgggtttggggtatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgaggtctcctgcaggcttctggagcaccttcagcgactatagttcaagttggggngccgacgggcctcgtggtaaccagggtccttggagttacggagttggggaaacggtctccgggttaccctaagtccgggtttagaaccaaccgtaaacccgtaaaacgtaccggccaaaccggtaaggtaaaccggtttccccggaagggggcctaaacggtcccttaacgaaccccgtaaggtaaaccccgcggggaaacctaaaagttaaaccgaaacctaaccgttaaacggtttaaactaccggtagggtaacgtaccgtaaggaaacccgacggtacccgtagttaccaacgttccgttaaggacggaaccgtacgggtcctttaccttacgttccgtggtcgtacggaaggtagttaaacttacgtaacgtaacctacgtacgtacctttacctttttaaccgaccctttacccgtttacgtacctttcggtaccgggtcctaagggttaccccggtaaccccgtaccgg

SEQ ID NO: 104576 - DNA, 867 bp, Homo sapiens
  misc_feature: GYAE6OF02FE7CH.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatcgtgggctgaggtgaacgcgccgtgggtcctcgggtgagggtctccgtgacaggtcttacgtggacggctaccgttcgacgcgtaactagttacgtttcaagtttcggggtgcggtaccgggtcctcgtacggacgtaacgggtccgtttagacggttagggagtacggggaaggtacgttcccggtacccttagttccggttacgaaccgtaaccgaaacccgtaaaacgtaccgaaccgtaacgaacggtaaccggtttacccgaaggggtacctaacggtacccttaacccgaaacccgtaaccggttaaaccccggaaccggtaaaccgtaaaaccgtttaaacccggaaaccgtaaaccgtttaaggttaaaccgttaccgtaacgggtaacgtacccgtaacggtaaaccgacggtacccgtttacgaccgtaacgttaccggaacgggtaaccggtaaccggtaaccgggtttaccttaccgtttaccgtttacgttacggttaccggtaacgggttaaacggtaaacgtttaacttaaccgttaaacgttaccgttaaccgtccggttttaaccctttaccgttttaaccccgtacccgtttcccgttacgttacccgttcccgggtaccgggtaccttaccgggtacccggttaaccccgttacccgg

SEQ ID NO: 104577 - DNA, 605 bp, Homo sapiens
  misc_feature: GYAE6OF02F8HEM.17.34.D01.1.454.CMB.1.raw
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcnggaggcaccttcagcgactatagtttcaattgggngcgacgggcctcgtggacaaggccttgngtggatgggaagatcgtcctatcgttgacacaccaaactacgcacagaacgtccaggcagactcacataaccgcgaacaaacttaacgaacaactagttaatctaggacgactacgaacagtcctagtcactcgtagaggaccgtacgggtcctttacgtacgttacttaggtcgacgtaaggtacgttaaacttactaataactactcgtacctttccctttttaacctaacccttcccgtttacgtacctttcgttaccggggtacctacggtaccggtaccccggtacccg

SEQ ID NO: 104578 - DNA, 631 bp, Homo sapiens
  misc_feature: GYAE6OF02JX1M2.17.34.D01.1.454.CMB.1.raw
  modified_base (281)..(281): a, c, t, g, unknown or other
  misc_feature (281)..(281): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggagcaccttcagcgactatagtttcaattggggtncggacgggtcctcgtggacaaggccttggagtggagtgggaaggatcgtcctagtcgttgacacaaccaaactcgcacgagaagttccgaggcacgactcaacataaccgcgaanaaactacganacagtatcgtgganctagacagtcctagactagtactaggaaggaccgaacgggtctttacgtacttccgtggttacgacgggtaaggtaacgttaaacgttacctaagtaaactaccgtgttacctttacccgttttaaccctaacctttcccgttacgttacctttccggttacgggttacccgtagttacccgggtaaccccggtttcaccccggtttaccc

SEQ ID NO: 104579 - DNA, 715 bp, Homo sapiens
  misc_feature: GYAE6OF02GKL4G.17.34.D01.1.454.CMB.1.raw
  modified_base (386)..(386): a, c, t, g, unknown or other
  misc_feature (386)..(386): n is a, c, g, or t
  modified_base (533)..(533): a, c, t, g, unknown or other
  misc_feature (533)..(533): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctacgggtgagggttctctggcaaggcttcgtggaggctaccttcgacgcgacttatagtttacaacgttgggtgtcgacgggtccttcagggaccaaggtccttgacggtggtacgtgggaagtacgtccgtaccgtattcggtagactacacctaaacgtcganacctaggtaacgttccgagggactagaccctacaaccgtacgtaaccggaccggaactaaacgtaacgtaacaactagttaactacgtggaacgcgtagaacgacgtcctacgtacgaacttcgtaggacggtaaccgcccgggttnttaaccgttccgtttacttacggtacggtacggtaacggttaacggttaaacgttaacttaacgtaagtacccgttagtttaccccgttaccttttttacccgaccccgtttacccgtttacgttaccgttaccggtttcccggggactacccggtttacggggtaaccccccgttacccgg

SEQ ID NO: 104580 - DNA, 558 bp, Homo sapiens
  misc_feature: GYAE6OF02IKAO7.17.34.D01.1.454.CMB.1.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcgaaggcttcgtggaggccaccttcagcgactatagtttcaattgggtgcgacgggcctctggacaaggccttggagtggagtggggaaggtatcgtcctatcgttgacacaccaaactacgacacagacgtcaggcagacncacanaccgcgaactaaataacgaacacaagtaanctanaggggcagaacacgactgtacatcgtagaggacgacggtcttactacttctgtgcgaggtagtaattactaatacactcgtcttacctttactccttaccttacgtcttcgtcggacctacgtaccggtacccgtacccg

SEQ ID NO: 104581 - DNA, 582 bp, Homo sapiens
  misc_feature: GYAE6OF02IERV7.17.34.D01.1.454.CMB.1.raw
  modified_base (326)..(326): a, c, t, g, unknown or other
  misc_feature (326)..(326): n is a, c, g, or t
  modified_base (389)..(389): a, c, t, g, unknown or other
  misc_feature (389)..(389): n is a, c, g, or t
  modified_base (472)..(472): a, c, t, g, unknown or other
  misc_feature (472)..(472): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttcgtggaggcaccttcagcgactatagtttcaattgggtgcgacgggcctcgtggacaaggccttgagtggagtgggaagntccgtcctatcgttagacacaccaaactacgcacagaagtccagggcaagctcacataaccgngaacaaattaacaacaactacgttaatcgtagagctaagacagcctgtacatcctaggacgacgacggtccttactaccgttntgtgacggtaggtaaagtaacttaactataactactcgttcttacccttttacctacccttcctttagtaccttcggtccgggacctacggtcccggtacccgttacccg

SEQ ID NO: 104582 - DNA, 661 bp, Homo sapiens
  misc_feature: GYAE6OF02I6277.17.34.D01.1.454.CMB.1.raw
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggatcctcttcttggtggcagcagctacaagtgcccactcccaggtgcagctggtgcagtcgtggggctgaggtgaagagccgtggggcctcagtgaggtctcctgcaggctcgtggattcgacgtttaccncctagtagtatcaacgtgggtnccgcgaggccgcgtgaccaacgaccgtgacggtggagtgggatgggacaactacccgtaacacgttggtacgtcaacgtgttcgtccttcacccgtagtcccgtacgggaactcggtaccttacgacgtacgaacccaccgtaacctaccctaccaaataaccaaccgacgtacctaactacggtacggtaggttacgagggtaccaccgtagaccagttcgacgggaacccgcgaccggtccgttactaaccgtttccgtaggtccgaacggcgttacccggacccgtacggtaaccggtcccgggttaagcccggtacccgtaagggtcccgtaacgggtccccgtccgttttaggaccccgtttcggacccggggg

SEQ ID NO: 104583 - DNA, 559 bp, Homo sapiens
  misc_feature: GYAE6OF02JOJSM.17.34.D01.1.454.CMB.1.raw
  modified_base (421)..(421): a, c, t, g, unknown or other
  misc_feature (421)..(421): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggggtctcctgcaaggcttctggaggcaccttcagcgactatagttcaattgggtgcgacgggcctcgtggacaaggccttgagtggagtgggaaggatcgtcctagtcgttgacacaccaaactcgacacagacgttccagggcagactacaccataaccgcgaacaataacgaacactaattaatacgaganactagaacagcctgtcatctagagacgacggtctactactcgtgtacgacgagtagttaacttacatactactacgtcttacctttacacccttccgttacgtcttcgtacggtacctacgtaccggtacccgtaccg

SEQ ID NO: 104584 - DNA, 668 bp, Homo sapiens
  misc_feature: GYAE6OF02GTIAN.17.34.D01.1.454.CMB.1.raw
  modified_base (361)..(361): a, c, t, g, unknown or other
  misc_feature (361)..(361): n is a, c, g, or t
  modified_base (556)..(556): a, c, t, g, unknown or other
  misc_feature (556)..(556): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctccgtgcgaaggtcttcgtggacggccaccttcaggcgaacttagttagtttcaagttggggtgcggaccgggtccctcgtggaacaaggtccttggaggtggagtggggaaggctcgtcctagtcgttanacacaccaaactcgaccacaagtaacgttccgagggcacgactcaaccaataacccgacggaacaaacgttaacgaacacgtaagttaactcgtaggacacgtagaaccgcgtactcgactagtacgacggacgtaacgcggtaccttctacgttcgaggtcgacgtaaggtacgttaacttactaagttaaccncttacgtaccttttacccgttttacctacccctttacccgttcgttacccgtttcggtccgggttaaccctacggttaccccgggtaaccccggttccctacccgttccccg

SEQ ID NO: 104585 - DNA, 542 bp, Homo sapiens
  misc_feature: GYAE6OF02IKBWI.17.34.D01.1.454.CMB.1.raw
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctctggacaaggccttgagtggagtggaggatcgtcctatcgtgacacaacaactacgcacagaacgttcaggcagactcacctanaccgcgactaaatacgaacacaagtatctganacngaacagctncatntgacgacncggnttctactgtgtgcgagtacgtaattacatactactgtcctttaccttttacacccttacccttgtactttccgtcgggtacctacgtaccggtaccccgtaccg

SEQ ID NO: 104586 - DNA, 550 bp, Homo sapiens
  misc_feature: GYAE6OF02G49M0.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaagatcgtccctatcgttgacacaccaaactacgcacagaagttccagggcagactcaccataaccgcgaacaaataacgaacacataatctaggagctagaacagcctgtacatctgaggacgacggcttctacttctgtcgcgaggtagttaatactatactactcgtcttaccttttactaccttcccttgtaccttcgtagggtcctagtccggtaccccgtacccg

SEQ ID NO: 104587 - DNA, 747 bp, Homo sapiens
  misc_feature: GYAE6OF02IXU7R.17.34.D01.1.454.CMB.1.raw
  modified_base (251)..(251): a, c, t, g, unknown or other
  misc_feature (251)..(251): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtgcagcagctacaggtgtccagtcccaggtccagttggtgcaatctgggctgaggtgaagacgccgtgggtcctcgggtgacgggtctccgtgcgaaggtcttcngggaacgcctaccttcgaagcgtaactagtagtttcaagttgggtgcggacggtctcgtaggacaaggtcctggagtggagtagggagctccgtccgtagtcgttagactaaccgacaaatcgacacagacgttcgaggcaagacttacaccgtaagtaacccggagaacgtaaacgtaacgaaacgtaacgtaaacgttaactaccggtaggtacgtactaacggaaactacggtaccgttacgtactaacgtaccgttagggaacggtaccggtaacgggttaccgtttacgttaaccgtttgtacggttacggacggttaaacgggtaacgtttaaaccgttaacgttaaaccgtaacgttacgttaaccggttaacccgttttacccgtttttaacccgtaacccgttttcccgtttaaggtttaacccggttttaccgggtcgggttaacccgttaaccggttaacccgggttaacccccgttaacccggg

SEQ ID NO: 104588 - DNA, 574 bp, Homo sapiens
  misc_feature: GYAE6OF02FZHXP.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcggacgggcctcgtggacaaggccttgagtggagtgggaagntcgtcctatcgttgacacaccaactcgcacagaagtccaggcagactcaccataaccgcgaacaaataacgaacacagttaatctaggagctagaacacgacccgtacatcgtagacggacgacgggtcttctacttctgtgacgagtagtaattactaataacactgtcttaccttttaccacccttccttacgtacctttcgtacgggtcctacgtaccgggtaaccccgtccgtacccgtcctacccg

SEQ ID NO: 104589 - DNA, 875 bp, Homo sapiens
  misc_feature: GYAE6OF02H34EQ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgagacgcctgggtcctcggtgagggtctcctgcaaggtcttcgtgggaggctaccttcagcgactatagttcaattgggtgcgacgggcctcgtaggacacggccttggaggtggagtgggaagagtccgttccctagttcgttggtaaccaccgaaccctaaacgtaccgacctaaacgacggtaacgttaccgaacgggtcaacggtacctaccaacccgtaaccttaaaccccggaccgggaaacctaaaacgttaaaccgaaaaccgtaacctaaacggttttaaactacggtagggtaacgtacgttaacggaaaccgacgtacccgttgttaccgtattacccgttagggaaaccgggtaacccgtaaccggggttacccttttacccggtttaaaccgttttccgtttacgggtttaccgggtaccgggtaaacggggtttaaacgtttaaaaccgtttaacccgtttaaacgttaaacccgtttaacccggttttaggttaccccctttttttaacccccggtttttttaacccccgtaccccctttttaccccccggttttaacggtttaccccgtttttaccccggggttaacgggggtttacccccccgttaacgggttttaccccccgggggtaaaccccccccggttttaccccccgg

SEQ ID NO: 104590 - DNA, 718 bp, Homo sapiens
  misc_feature: GYAE6OF02IPG2U.17.34.D01.1.454.CMB.1.raw
  modified_base (328)..(328): a, c, t, g, unknown or other
  misc_feature (328)..(328): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtggagcaccttcagcgactatagtttcaagttgggtgcggacgggcctcgtggacaaggtccttggagtgggagtggggaagntcgtcctatcgtagacacaccaacgtacgcacagaacgtccgaggcagactacaacaactaaccgacggaactaaacgttaaacgaaccaacgtaagttaaactcgtaggactacgtagaaaccgtagaccctagtacctacgtacgttacggaacggtaccgtaccgggtactttacgtaccgtttcgtacggtacggtacggtaacggtaacgtttaaacgtttactaaaacgttaaccgtaccgtttcgttacctttttaccccgtttttaaccctaaccccgttttaccccgtttacggttaacccgttttccgggtaccggggtaaccctttaccgggttacccgggtaaacccccccgggtttcccgtaaccccggtttccccg

SEQ ID NO: 104591 - DNA, 609 bp, Homo sapiens
  misc_feature: GYAE6OF02FZFC6.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacggcctctggacaaggccttgagtggatgggaagatcgtcctatcgtgacacaccaaactacgcacagaagttcgagggcagactcaccataaccgcgaacaaactaacgaacactagtaatctagacgctagaacacgacctgtacatcgtagacggaccgacgggtacttactacttcgttagtggacgtaaggtaagttaatttaactaacgtaactaccgtcgtacctttccctttttaaccctaccctttacccgtttacgtaccgtttccggttacgggtacccgtacggttaccgggtaacccccggttacccg

SEQ ID NO: 104592 - DNA, 836 bp, Homo sapiens
  misc_feature: GYAE6OF02IE0WU.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcacatggactggacctggaggttcctctttgtggtggcagcagctacgaggtctccacgtcccaggtcctaggttggtgacaatcgtggggctggtacggtagaaacgccgccgttgggtccgttggtggtacgggttcctaccgtgacgaacggtccttcggtgggacgccctaccttcgagtccgtaacttagttacgtttctaagtttgggtcgacggaccgggtccttcgtacgggaactacgggtcccgtttaggacggttagggtaggttaggggaacgttccgttacccgttacccgttagttacccgggtttaacgacccgtaacccaaacccgttaaaacgtaccggaccgaaacggtaacgtaaccggttccgaacgggtacgaacgtacctacgaacctacgtaacccggaacggtaactaaacgtaaaccgaactaacgtaacgttaaacgtcgtaaggtacgtacgtacgaaccgtacgtccttacgtactacgttccgtagacggaccggtcgggttaccttacggtttacctcggttacggtcggtaccgggtaagtaaacgttaaacctttacctaagttaaccgtacggtttaccgtttccccttttaaacccgtttttacccaccccttttacccgttaccgtttacccggtttaccggtaccgggttacccgtaacgggtttaccccgggaaccccgtttaccccg

SEQ ID NO: 104593 - DNA, 686 bp, Homo sapiens
  misc_feature: GYAE6OF02IAP8Y.17.34.D01.1.454.CMB.1.raw
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (558)..(558): a, c, t, g, unknown or other
  misc_feature (558)..(558): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggagcctaccttcagcgactatagtttcaagttgggtgcgacgggcctgtgacaggtccttgagtggagtgggaagntcgtcctatcgtnacacacaactacncaacagtagtaccgaggcacgtacaccaccaactaaccgacggaactaaaacgtttaaccgaactaagtaacgtttaaacgtcgtaggaactaccgtaagactacgtcctaggtacctacgttctaggaacggaccgtacgggtacctttcgttaccgttcgtcgttacggacggtaaggttaaacgtttaacttactaacgttaaaccncgtttaccgtaccctttttacccgttttaactacccccgtttaccgttacgtttaccgttaccgggtaccgggtacgtaacccgggttacccgggtaacccccggttacccgttacccgttacccccg

SEQ ID NO: 104594 - DNA, 651 bp, Homo sapiens
  misc_feature: GYAE6OF02F5AZ8.17.34.D01.1.454.CMB.1.raw
  modified_base (287)..(287): a, c, t, g, unknown or other
  misc_feature (287)..(287): n is a, c, g, or t
  modified_base (336)..(336): a, c, t, g, unknown or other
  misc_feature (336)..(336): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaagggcttacgtggaggcaccttcagcgactatagtttcaagtttgggngcgacgggcctcgtggacaagggtccttaggagtgggatggggaaggtntcgtaccctagttcgtagaccacaaccaaatcgcacaggaacgtccagggcaagctacaccaagtaccggacgaacaaagtaacgaacaactagttaacgtcttagggactacgtacgaaacaggtacccttagtaccagttccgtaggtaacggtccggaccgggttcttaccgtacgtttcgtcggtgtaccgaggtacgttaaacttacgttaactactacgtcggttcctttacccgttttaacctacccttccctttaggtacctttcggaaccgggtaccctaccggtaccgggttacccccgtaccgg

SEQ ID NO: 104595 - DNA, 904 bp, Homo sapiens
  misc_feature: GYAE6OF02JC746.17.34.D01.1.454.CMB.1.raw
  modified_base (156)..(156): a, c, t, g, unknown or other
  misc_feature (156)..(156): n is a, c, g, or t
  modified_base (816)..(816): a, c, t, g, unknown or other
  misc_feature (816)..(816): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggagttctctttgtggtgcagcagctacnggtgtccagtcccaggtccagttggtcgacaagtctggggctggaggttgaagaccgccgtgggtccttcggtgacgggtctccgtggactaagggtcttcgtcgggacggtcctaaccgtttcgaacggccgtaacttacgttacggtttaccaaggtttgggttacggccggtaaccgggtccctttacgcgggtaaactaacgggtccctttaggacggtaggtagttacgggggaaggtactttccggtaccccgttaaaggtttccggttacggtaaccctaaccggtaaaaccccgtaaaagtcccggttaacgaacgtaacggggtaacctttaccgggaaggggacccaaacggtaacccttaccggtaaaccctaaacggttaaccccgggaaggtaaacctaaaacgttaaacccgaaaccgtaaactaacggttaacgttacgtacggtaagtaccgtaacgtaaaccgtacgttaccgttacgttaaccgtacttaccgggaggtaacccgggttaccggaaaccgggtttcctttaacgacccgttttacgtaggttaccggtaaccggtaggttaaacgtttaaaacgtccgtttaaaccgttacgtccggtttaaccgtacccgttttaaccgtttttaaacccncccgttttacccgtttaccgggttaacccgttttccgggtaccggggttaaccctttaaccgggtacccggttaaccccggttacccg

SEQ ID NO: 104596 - DNA, 874 bp, Homo sapiens
  misc_feature: GYAE6OF02IJRAX.17.34.D01.1.454.CMB.1.raw
  modified_base (192)..(192): a, c, t, g, unknown or other
  misc_feature (192)..(192): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacgaggtcgtaccacgtcccgaggtcctaggttggngactaatcggtgggctaggaggtagaacgaccgtccggttcgggtcccgtggtggtacggtcctcgtgacgaggtcttcgnggngcctaccttnacgcgtacttagttacgttactaaggttggtcgcggtaccggtccttcggcggaactacggtccttaggacggtagggaggtaggggaaacgtcgttacccgttaccgtagttccgttagaaccctaccaaacccgtaaaccgttaccgaccgaacgtaaacggttaacgttcccggaagggacctaaacggtcctaacccaaccgtaaccgttaacccgggacggtaaaaccttaaaaacggtttaaacccgaacctaaaacgttaaacggtttttaaactacccgggtaagggtaaaccgttacgaaaccgggtaaccgtaccggtcccgttaacgttaacgaacgtttccggtaacggggaaccgggtaaacccggttccggggttaccttttaaccgtttacccgtttggttacgggtaccgggtaacggttaaacggttaaacgtttaacctttaaaccgttaactaaacccgttacgtttccggtttaaccctttttttaccccttacccgtaccccttttaccgttagtttacccgttcgggtaccggtaaccctacggttccccggtaacccccgttccg

SEQ ID NO: 104597 - DNA, 669 bp, Homo sapiens
  misc_feature: GYAE6OF02GOX4O.17.34.D01.1.454.CMB.1.raw
  modified_base (450)..(450): a, c, t, g, unknown or other
  misc_feature (450)..(450): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggatcctcttcttggtggcagcagctacaagtgcccactcccaggtgcagctggtgcagtcgtgggctgaggtgaagagccgtggggcctcagtgaaggtctcctgcaggcttctggattcacgttttacctcctatagtatcaactgggtgcgccgaggccgctcggacaaccgacctggagtggagtgggagtcgggaccgaaccctaacacgtggtacgtaccacgtaggttcgtccttaccaccctactcccgtaccgggaacaacgtaccttaaccagttccgaaccaaccgtaacctccctaaccaactaaaaccncaacgaccctaagaatacggagttaggaggtacgactagaacctagtacctagggaccgtaaccggaccgggtacccgttacgttaactttaccgtgttacggacgaacggtaccgttaccccgacggtaccggttcccgggtaggaaccggtacccggtaccggacggtaccggtaccggttcccgtttacggtacccgtttggccggggtaaccggg

SEQ ID NO: 104598 - DNA, 559 bp, Homo sapiens
  misc_feature: GYAE6OF02GLFAF.17.34.D01.1.454.CMB.1.raw
  modified_base (283)..(283): a, c, t, g, unknown or other
  misc_feature (283)..(283): n is a, c, g, or t
  modified_base (323)..(323): a, c, t, g, unknown or other
  misc_feature (323)..(323): n is a, c, g, or t
  modified_base (413)..(413): a, c, t, g, unknown or other
  misc_feature (413)..(413): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcaaggcttctggaggcaccttcagcgactatagttcaattgggtncgacgggcctgtggacaaggccttgagtggatgggaaggntcgtcctatcgttgacacaccaactacgcacagagttccaggcagactcaccataaccgcgaacaataacgaacacagttaatctagganctagaacagcctagctatctagaggacacggtcttctacttctgtcgagtaggtagttaattactatactactgtccttaccttttaccaccctttacccttcgttaccttcgtcgggtacctacggtaccggtaccccgtacccg

SEQ ID NO: 104599 - DNA, 557 bp, Homo sapiens
  misc_feature: GYAE6OF02GMR38.17.34.D01.1.454.CMB.1.raw
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (509)..(509): a, c, t, g, unknown or other
  misc_feature (509)..(509): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtnaagacgcctgggtcctcggtgagggtctcctgcaaggcttcnggacgcaccttnagcgactatagtttccaagttgggtgcggacgggcctcgtggacaaggtccttgagtggatgggaagntcgtcctatcgttnacacacaaactcncanagaacttcagggcagactcacataccgcgaacaataacgaacacagttaatcgtagagctagaacacgcctagtctatctgacgacgacggtcttctacgtttctgtgcgtagtagtaacttactataactctcgtactttaccttttaccnccttacccttgtaccttcggtccgggtcctacgtccggtacccgtccg

SEQ ID NO: 104600 - DNA, 559 bp, Homo sapiens
  misc_feature: GYAE6OF02F40KV.17.34.D01.1.454.CMB.1.raw
  modified_base (247)..(247): a, c, t, g, unknown or other
  misc_feature (247)..(247): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaggcttcnggagcaccttcagcgactatagtttcaagttgggtgcgacgggcctctggacaggccttgagtggagtggggaagcgtcgtcctatcgtgacacaccaactacgacacagaacgttcagggcagactcacacgtaaccgacgaacaacttaacgaacaactaagtaatacgtaggagctagaacacgcctagctatcagaggacacgggtcttactacttctgtgcgagataatactatacatacgtctttacctttacacccttccgttagtaccttcgttccgggacctacgtaccggtaccccgtaccg

SEQ ID NO: 104601 - DNA, 612 bp, Homo sapiens
  misc_feature: GYAE6OF02FR8M2.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaggccttgagtggatgggaagatcgtcctatcgtgacacacaactcgcacagacgttccagggcagactcaccataccgcgaacaataacgaacacagtaatctaggagctagaacacgtaccttgtcatcgtgacggacgacgggtcttacgtactttccgtagtggtaccgaggtaacgtaaacttaacgttaacttaacgtaccttaggttaccctttacccttttttaaccctaccctttaccccgtttacgttaccgttaccggttccggggtaccctacggttacccgggtaccccggttaacccgg

SEQ ID NO: 104602 - DNA, 567 bp, Homo sapiens
  misc_feature: GYAE6OF02GFT1J.17.34.D01.1.454.CMB.1.raw
  modified_base (325)..(325): a, c, t, g, unknown or other
  misc_feature (325)..(325): n is a, c, g, or t
  modified_base (385)..(385): a, c, t, g, unknown or other
  misc_feature (385)..(385): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagtttcaattgggtgcgacgggcctcgtggacaaggccttgagtggatgggaaggntcgtccctatcgttgacacaccaaactacgcaacagaacgttccagggcagactcaccanaccgcgacaataacgaacacagtaatactggagctagaacacgcctgtcatctagaggaccgacgggtcttctacttctgtgcgagagtaattactatacactgtcttaccttttacctacccttaccctttcgtaccgtttcgtcgggtaccctacgttaccgggtacccccggttacccg

SEQ ID NO: 104603 - DNA, 782 bp, Homo sapiens
  misc_feature: GYAE6OF02HXJC8.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctccgtgcaaggcttacgtggaggccaccttcagcgacttatagtttcaagttgggtgcggaccgggcttactggaaccaaggtccttggaggtggagtcgggaaggagtcgttccctaagtcgttagaccgacgaacaaactacgacaacgagtaacgttcgacggcaacgtactaccaaccgaacgtaacccggacgggaacctaaaacgtttaaaccgaaacctaaaccgtaagtttaaaacgtccgttaaggtaacgtactaacggaaacgtacggacccttaagggtacctaacgtacgtacgggtaaacggaaccgtaaccgggggttacctttaaccgtttacccgtttacggttacggttacggacccggtaagggttaaacgttaaaccgtttaaaccgttaactttaaacccgtaccgtttacgtaaccctttttacccggtttttaccctaaaccccgtttccccgtttaggttaccccgtttccgggttaccggggtaccccttaacggttacccggggtaaaccccccgttacccgg

SEQ ID NO: 104604 - DNA, 564 bp, Homo sapiens
  misc_feature: GYAE6OF02HRYF1.17.34.D01.1.454.CMB.1.raw
  modified_base (416)..(416): a, c, t, g, unknown or other
  misc_feature (416)..(416): n is a, c, g, or t
  modified_base (508)..(508): a, c, t, g, unknown or other
  misc_feature (508)..(508): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctctgcaaggcttctggagcaccttcagcgactatagtttcaatttgggtgcggacgggcctcgtggacaaggccttgagtggagtgggaaggagtccgtcctagtcgttgacacaccaaactacgcacagacgtcaggtcagactcaccataccgcgaacaataacgaacacattaatctaganctagaacagctgtcatcagagacgacggtcttactacttcgtgtcgacgtaggtataattactaatactactcgtacctttcccttttaccnccctttacccgttagtacgttcgtacgggtacctacgtcccggtacccgttacccg

SEQ ID NO: 104605 - DNA, 541 bp, Homo sapiens
  misc_feature: GYAE6OF02GXBSL.17.34.D01.1.454.CMB.1.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtccctatcgttgacacaccaaactacgcacagagttccagggcagactcaccataaccgcggaacaaattaacgaacaacagttaatcgtggagctagacagcctgtcatctgaggacacgggtcttctacttctgtgcgagagtaattactatacactgcttaccttttacacccttccttgtacttcgtcgggtccacgtccggacccgtccg

SEQ ID NO: 104606 - DNA, 578 bp, Homo sapiens
  misc_feature: GYAE6OF02GRULV.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggagntcgtcctatcgtgacacacaactacgcacagaattccgaggcagactcaccataaccgcgaacaaagtaacgaacacacgttaaatcgtagagactagaaccagtcctagtacattacgtagaggaccgacgggtcctttacgtacgttctagtcgacgaagggtactaaattactattacctactacgtcttaccctttttaccaccttccctttgaccgtttcgtacgggtcctacgtacggtaccccgtaccg

SEQ ID NO: 104607 - DNA, 635 bp, Homo sapiens
  misc_feature: GYAE6OF02IBLXT.17.34.D01.1.454.CMB.1.raw
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacaggtgtccagtcccaggtccagttggtgcaatctggggctggaggtgaagacgccgtgggtcctcggtgagggtctcctgcaaggcttgtggagcctaccttcgagccgaacttattagtttccgtaagtttggggtgcggaccggggtcctcgtaggacaacggtccttaggaggtggagtgggagctcgtccctatcgttgacacaaccaactacgacacgagaacgttccgaagggtcacgtctacaaccacgtaaccgacgaactaaactaacgaacactaagttaatcgtaggacgtctacggaacacgtacccgtacacttacgtgacggacgtacgggtcttacgtaccttcgtcggtcgtacggtaagtacgtaacgttactaagtaactacgtacgtccgtttacctttacccaccttccttacgtacttcgcgggtacctacggtaccggtaccccgtctacccg

SEQ ID NO: 104608 - DNA, 589 bp, Homo sapiens
  misc_feature: GYAE6OF02I5VHU.17.34.D01.1.454.CMB.1.raw
  modified_base (327)..(327): a, c, t, g, unknown or other
  misc_feature (327)..(327): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcggtgagggtcctcctgcaaggcttcgtggacggcaccttcagccgactatagttcaattgggtgcggacggcctcgtggacaaggtccttgagtggatgggaagtntcgtcctagtcgttgacacaccaaactcgcacagtacgtcaggcagactcacagtaaccgacgaactaataacgaacactagtaactcgtaggatacacgaacgacgtctacgtcaatctagacggacgtcggtacttactacgtttcgtcggtacgacgtaggaattaacgttatactacacttcgtacctttccttttaacaccccttccttacgtaccgtttacgtcgggtaccctacgttaccggtaccccgttcccg

SEQ ID NO: 104609 - DNA, 626 bp, Homo sapiens
  misc_feature: GYAE6OF02JEDIY.17.34.D01.1.454.CMB.1.raw
  modified_base (291)..(291): a, c, t, g, unknown or other
  misc_feature (291)..(291): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgctgggtctcggtgaggtctcctgcaaggctctggacggcaccttcagcgatatagttcaattgggtgcgacgggctcgnggtacaggtcctgagtggagtgggaagagtccgtcctagtcgtagacctacgaaccaaacncgtacacagtacgtcgagggcagactcacactaccgngaactaaataaccgaacactaagttaatcgtaganactaggaaccngtacctgtacactgtacgaaggtaccgacggtccttactaccgtttgacggtacggtacgaaggtaacgtttaactaacgttaactaacccgtagtacccggttaacttttacccgttttacaacccctttccgttacgttaccctttcggtacccgggttccaacgttaccccgggtaccccgttacccg

SEQ ID NO: 104610 - DNA, 595 bp, Homo sapiens
  misc_feature: GYAE6OF02FLC2L.17.34.D01.1.454.CMB.1.raw
  modified_base (327)..(327): a, c, t, g, unknown or other
  misc_feature (327)..(327): n is a, c, g, or t
  modified_base (431)..(431): a, c, t, g, unknown or other
  misc_feature (431)..(431): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttctggaggcaccttcagcgactatagtttcaagtttgggtgcggacgggcctcgtggacaagggccttggagtggatgggaagntcgtcctatcgtgacacacaactcgcacagaatccgaggcagcacaccataaccgcgaacaaataacaacacagtaatcgtagagctagaacagctagtcatcngacggacgacggtcttactacttcgtgtcgtacgaggtacgttaaacttactaactaacgaccgtacgttaccctttacctttttaaccctaccccgttacccgtttacgttaccgtttccgttaccggggtcccttacggttaccggtacccccggttacccg

SEQ ID NO: 104611 - DNA, 629 bp, Homo sapiens
  misc_feature: GYAE6OF02ICGTI.17.34.D01.1.454.CMB.1.raw
  modified_base (248)..(248): a, c, t, g, unknown or other
  misc_feature (248)..(248): n is a, c, g, or t
  modified_base (282)..(282): a, c, t, g, unknown or other
  misc_feature (282)..(282): n is a, c, g, or t
  modified_base (386)..(386): a, c, t, g, unknown or other
  misc_feature (386)..(386): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (515)..(515): a, c, t, g, unknown or other
  misc_feature (515)..(515): n is a, c, g, or t
tcagcgtagactagcacgaccggtgctcgatttagatcgtctgtgttgggtttggggacaaaacaaccagattcctcctctaaagaagccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctccgtgcaaggcttcgnggagcacttcagcgatatagtttcaagttgggtncggacgggtctcgtggacgaaggtccttggagtggagtaggggaagtactccgtcctagttcgttgacaacgaccaaactcgacacagacgtccgaggcagacncacataccgcgacaagtacacatatatcgtaganctacgaacncgcngtcagtcaggagacgacggtcttacgttacttcgtgtacggacgtaacggtaacttaacgtttaactaacgttaaacccgtnttaccgtttaccttttaccccgtttttaacctacccttccctttacggtaccgtttcggttacgggacccttacggtaccccgggtaaccccggttccgtaccccgtttacccg

SEQ ID NO: 104612 - DNA, 636 bp, Homo sapiens
  misc_feature: GYAE6OF02JV3LV.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctccgtgcaggcttcgtaggaggccaccttcagcgtactatattacaagttgggtacgcgtacgggcctcgtggacaaggtcttggagtggagtgggaagctccgtctagtcgtgactacgacctaaacgtcacgacaagtacgttaccgagggtacacgtacctacgaacctaacgtaaccgacggtaaactaaacgtaaacgaacgaataacgttaatacgtagactactagaacagaccgttacgactactgacgaagcgaacggtcttacgtcttcgtagtgtagaggtaacgtaattacgtaataactacttacggtcctttaacccgtttactaccgtttacccttagtactttcggtacccggtacgtaccgggttcccggtaacccgttccccgg

SEQ ID NO: 104613 - DNA, 764 bp, Homo sapiens
  misc_feature: GYAE6OF02GTN9W.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctgggtgagggtctccgtgacaaggcttcgtggacggcctaccttcagcgactattagtttcaagttgggtgcggtacgggcctcgtaggacaaggccttggaggtaggacgtaggggaaggtacgtccggtcccttagtcggtagaaccaccaacctaaactacgaccaacgaaggtaacgttccggaggtacacgactaccaaccaacgtaaccgccggaaactaaacgtaaaccgtaaacaacgtaagttaactacgtaggtaacgacgtaacgaaacgtacgtaccgtacgttaccgtaacgttacgtacgggaacggtaaccggaccgggttacctttaccgttaccttacgttagggtacgtaacgggttaagggtaaacgtttaaacgttaaccgttaacgttaacctaaccggttaccgttaaccctttttaacccgtttttaaccctaacccgttttaccctttaaccggttaaccgtttcccggtaccgggttacccgtaaccgggttaccccgggtaccccggttaacccccgg

SEQ ID NO: 104614 - DNA, 555 bp, Homo sapiens
  misc_feature: GYAE6OF02IB86E.17.34.D01.1.454.CMB.1.raw
  modified_base (296)..(296): a, c, t, g, unknown or other
  misc_feature (296)..(296): n is a, c, g, or t
  modified_base (443)..(443): a, c, t, g, unknown or other
  misc_feature (443)..(443): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
tcagcgtagactagcacgaccggtgctcgatttagatcgtctgtgttgggtttgggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaaattgggtgcgacgggcctntggacaagggccttgagtggactgggaaggatcgtcctagtcgttgacacaccaaactcgcacagagttccaggcagactcaccataaccgcggaacaataacgaacacagttaatcgtggagacgtagaacacgtcctgtacactntgaggacgacggcttctacttctgtagcgagagtaattntatacnctagcttaccttttacacccttccttcgtacttcgtcgggtacctacgtaccggaccccggtacccg

SEQ ID NO: 104615 - DNA, 575 bp, Homo sapiens
  misc_feature: GYAE6OF02F3TLQ.17.34.D01.1.454.CMB.1.raw
  modified_base (324)..(324): a, c, t, g, unknown or other
  misc_feature (324)..(324): n is a, c, g, or t
  modified_base (427)..(427): a, c, t, g, unknown or other
  misc_feature (427)..(427): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgagacgcctgggtcctcggtgagggtctcctgcaaggcttctggaggcaccttcagcgactatagtttcaattgggtgcgacgggcctcgtggacaaggccttgagtggatgggaaggtntccgtcctatcgtgacacaccaactcgacacagaacgttccgaggcaagactacaaccataacccgacgaacaaacttaacgaaacacaagttaatctaggancgtagaacacgcctgtacactcgtgacggacgacggctttacctacttcctggtcgcgaggtagtaattactagtatacgtcgtacttcccttttaccacccttcccttagtaccttcgtccgggtcacgttaccgtaccccgtaccg

SEQ ID NO: 104616 - DNA, 708 bp, Homo sapiens
  misc_feature: GYAE6OF02F72CT.17.34.D01.1.454.CMB.1.raw
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (356)..(356): a, c, t, g, unknown or other
  misc_feature (356)..(356): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgacggtctccgtgcaggcttcgnggacgtcaccttgagcgacttagtgtttacaagtttgggtgcggtaccgggccttcgtggaacaaggtccgttaggngtggagtgggaagtctcgtcctagtcgtnacacacaaactcgacacgagtacgtccgaggccagactcaccgaactaccggacgaaactaaacgttaacgaaactaagtaacttaagtcgtaggactacgtacgaacgacgtaccgtagtactagttaccgtacgggaacgtacccggtacgggttacctttacgttacccgtcgttacggtacggtaaccggtaaggtaacgttaaacgtttaaccgtacttaaccgtacgttaccggttacccttttaacccgtttttaacccgaccccttttacccgtttaccggttaaccgtttccggtacggggttaaccctaaccggtttacccgggtaaccccccgtttacccg

SEQ ID NO: 104617 - DNA, 792 bp, Homo sapiens
  misc_feature: GYAE6OF02GLEJ5.17.34.D01.1.454.CMB.1.raw
tcagcgtagactagcacgaccggtgctcgatttagatcgtctgtgttgggtttgggggtagtcacaaaacaaccaagattcctcctctaaagaagcccctgggagcacagctcatcaccatggactggacctggaggttcctcttgtggtggcagcagctacaggtgtccagtcccaggtccagtggtgcaatctggggctgaggtgaaggacgccgtcgggtcctcgggtgacgggtctcctgcaaggtcttcgtgggacgctacctgacgcgacctagtagttcaagtttgggtcgacggaccggggtcctcgtacgggacgaacggtcccgtaggtacggtggagtaggggaaacggtgtttacccgaccccgttagtccggttaggtacccaacaacccgtaaaactccggtacaacggagtaaaccggttccgaaggtacgtaacaccgtaccaacctaaagtaacccgggaacggaacctaaaaacgtaaacgtaaaacgtaacctaacggtaaacgtccgtaaggtacgaccgtaacgaactaacggacctacggtacctaagtacgtacggaacggtaaccggaaccgggtacttaccgttaccgttacgttacggtcgtacggtaacggtaaagtaacgtttacgtaacttaaccgtaacgttccggttaacccgtttacccgtttttaacccaacccgttttaccccgtttaggttaacccggttttacggttacccgggggtaacctacccggttaacccgggtaaccccggttaccccgg

SEQ ID NO: 104618 - DNA, 637 bp, Homo sapiens
  misc_feature: GYAE6OF02JCC0V.17.34.D01.1.454.CMB.1.raw
  modified_base (411)..(411): a, c, t, g, unknown or other
  misc_feature (411)..(411): n is a, c, g, or t
tcagcgtagactagcacgaccggtgctcgatttagatcgtctgtgttgggtttggggacgaaaacaaccagattcctcctctaaagaagcccctgggagcacagctcatcaccatggactggacctggaggttcctcttgtggtggcagcagctacaggtgtccagtcccaggtccagttggtgcaatcgtggggctgaggtgaagacgcctgggtcctcggtgagggtctcctgcaaggtcttccgtggacggcaccttcgagccgactatacgttcaattgggtgcgacgggcctcgtggacaggtcctggacgtggagtgggaagatcgtcctagtcgttgacacaccgaaactcgcacgagaacgttcgaggcagactcacactaaccgcgaacaaactaaccgaanacaagtaatactacggagactagaacacgacctgtacatctaggacgacgacgggtcttactacttaccgttgtcgtacggaggttacgtaacgtttaactaacgtaacgtactcgtacctttacccgtttttaaccaccctttacccttagtacccgtttacgggtacccgggtacctaaccggttacccggtaacccccgggttaccgtaccccgtttacccgg

SEQ ID NO: 104619 - DNA, 615 bp, Homo sapiens
  misc_feature: GYAE6OF02HZGWD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggtccttggagtggatgggaagagtcgtcctatcgttgacacaccaaactacgacacagtaagtccagggcagactacaccaagtaacccgcgaacaaaacgttaacgaaacaacctaagttaaactcgtaggtacgactagaacaagccttgtacattccgagaggaccacgggtccttactacttcgtgtacgcgtaaggataaacttacgtaataacctacttacgtcctttcccttttaacctacccgttaccctttcggtactttccggtccgggtaccctaacggtaccggtaacccccgtacccg

SEQ ID NO: 104620 - DNA, 644 bp, Homo sapiens
  misc_feature: GYAE6OF02GNKNB.17.34.D01.1.454.CMB.1.raw
  modified_base (327)..(327): a, c, t, g, unknown or other
  misc_feature (327)..(327): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggctaccttcagcgactatagtttcaagttgggtgcggaccgggcctcgtggacaaggccttgagtggatggggaaggntccgtacctagtcgttagaccacaccaacgtacgcaacgagacgtccaggcagactcacactaccgacgaactaaacgtaacgaacacgtaagttaatcgtaggactacgtacgaacgtacgtacctacgtactatcgtaggacggacgtaccggtctttactactttcgtacgtgacgtaggtaagttaattactaagtaacctacgttacgttacctttaccgttttaacctaccctttcccttacgttaccgtttccggtacgggtaccgttaccggttacccgggtaccccggttacccgtacccgttacccg

SEQ ID NO: 104621 - DNA, 589 bp, Homo sapiens
  misc_feature: GYAE6OF02F3F9Y.17.34.D01.1.454.CMB.1.raw
  modified_base (282)..(282): a, c, t, g, unknown or other
  misc_feature (282)..(282): n is a, c, g, or t
  modified_base (385)..(385): a, c, t, g, unknown or other
  misc_feature (385)..(385): n is a, c, g, or t
  modified_base (434)..(434): a, c, t, g, unknown or other
  misc_feature (434)..(434): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtggaggcaccttcagcgactatagtttcaattgggtncggacgggcctctggacaaggccttgagtggatgggaagatcgtcctagtcgttgacacaccaaactcgcacagaacgttcagggcagactcaccataaccgngaacaaattaacgaacactaagtaactctaggagctagaaaccagcctntactactctaggaacgacgacggtccttactacttcgtgtcgacggtaggaacgttaaacttactaacgtaactacgtcgtaccttaccttttaacaccctttccttcgtaaccttcggtcggtacctacgtaccggtacccggtcctacgtccc

SEQ ID NO: 104622 - DNA, 594 bp, Homo sapiens
  misc_feature: GYAE6OF02GHMDA.17.34.D01.1.454.CMB.1.raw
  modified_base (389)..(389): a, c, t, g, unknown or other
  misc_feature (389)..(389): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagtttcaattgggtgcgacgggcctctggacaaggccttgagtggatgggaaggactcgtccctagtcgttgacacaccaaactacgcacagaacgttcgaggcagactcaccataccgngacaaataacgaacacagtaatcgtggagctacgaacacgcctagtcatactagagaccgacgggtccttacgtactttcgtagtcggagaggtaacgttaacttaactacttactacgtacgtcctttaccttttaacctaccctttacccgtttacgtacgtttccggtcgggtacctacggtaccggaaccccggttacccg

SEQ ID NO: 104623 - DNA, 575 bp, Homo sapiens
  misc_feature: GYAE6OF02IXJ5S.17.34.D01.1.454.CMB.1.raw
  modified_base (287)..(287): a, c, t, g, unknown or other
  misc_feature (287)..(287): n is a, c, g, or t
  modified_base (330)..(330): a, c, t, g, unknown or other
  misc_feature (330)..(330): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctccgtgcaaggcttcgtgggagccaccttcagcgactatagtttcaagttgggngccggacgggcctgtggacaaggccttgaggtggagtgggagntcgtcctatcgtgacacacaactcgcacagagtccaggcagactcaccanaccgcgaanaatacgaacacagttatcngganctagaacacgcctgtacagttcgagacggacgacggtcttactaccgttgtgtcgacgtaggtattaacgttacgtaatacgacttcgtctttaccctttaccacccttcccgttacgtacgttccgtaccggggccctaggtacccgggtaaccccgtcccg

SEQ ID NO: 104624 - DNA, 631 bp, Homo sapiens
  misc_feature: GYAE6OF02GHD9T.17.34.D01.1.454.CMB.1.raw
  modified_base (339)..(339): a, c, t, g, unknown or other
  misc_feature (339)..(339): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgcaatcgtggggctgaggtgaagacgccgtgggtcctcggtgagggtctcctgcaaggcttcgtggaggctaccgttcagcgtactatagtttacgaagtttgggtgcgtacgggtcctcgtggacaaggtccttggagtggatgggaaggntcgtcctagtcgttagacacacaactacgcacagaacgtccgaggcagactcacacgaacgcgaacaataacgaactactaagtaatacgtaggacgacgtagaacacgtccttgtacatcgtagacggtaacgaccgggactttacgtaccgtttgtacggtcgtaacgggaagtaagttaacgttaactaagtacgtacgttccgtacctttaccttttaccgtacccgttccgttagtaccgtttcggtaccgggttaccctacggttacccggtaaccccggttcccg

SEQ ID NO: 104625 - DNA, 705 bp, Homo sapiens
  misc_feature: GYAE6OF02GWUTI.17.34.D01.1.454.CMB.1.raw
  modified_base (336)..(336): a, c, t, g, unknown or other
  misc_feature (336)..(336): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatctggggctgaggtgaagacgccgtgggtcctcgggtgagggtctcctgacaaggcttcgtggacggtcaccttcagtccgactattagtttcaagtttggtagcgacgggctcgtggacaaggccttggagtggagtaggggaagnttccgtcctagtcgttagaccacaccaaacgtacgacacaagtaacgttccgaagggcaacggactaccgaaccagtaaacccggacgtaaacaaacttaacgaacctaacgtaacgtttaaactcgtaggaacgtactacgtaaccgacgtccttagtactacgtcgtacgaacggaccgtacggtccttaccttacgtttacgtggtaccgtaacggaaggttacgttaaaccgttaacttaaccgtacgttaactccggttaacccttttacccgttttaaccacccgttttaccccgtttacgttacccgttttccggtacccgggttacctaaccggtttcccgggtaacccccggtttacccg

SEQ ID NO: 104626 - DNA, 807 bp, Homo sapiens
  misc_feature: GYAE6OF02HY82Y.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccaggttggtgcaatcgtggggctggaggtgaagacgccgtgggtcctcgggtgaggtcctccgtgcgaaggtcttcgtggagcctaccttcgagcgtacttaagttagtttacgtaagttgggtcgcggaccgggcctcgtggacgtaacggtcttggaggtggagtggggaaggacgtcgtcctagtcgttagacaaccaacctaaacgtaccgacaacgacgtaacgttaccgacggacaacgaacctaccgaacctaacgtaaacccggaccggtaaaactaaaaaccgtttaaaccgaaacgtaaaccgtaaacggttaaacgttacgtacggtaacggtacgtaacgtaaacgacggtaccgttcgttaaaaaaaaaaaaaaaaaaaaaaaaaaacctcgtacgtacggtaacggaaccggtaccgggtacgttactttaaccgtttaccgttggtacggtacgggtacgggtaacgttaaacgttaacgttaacgttaacgtaacgttacgttacctttaccttttaacccttaccctttacccgtttaccgttaccgtttaccggttaccgggtacccggttaccggttacccgggtaccccggttacccgtacccgttaccccg

SEQ ID NO: 104627 - DNA, 595 bp, Homo sapiens
  misc_feature: GYAE6OF02GSL16.17.34.D01.1.454.CMB.1.raw
  modified_base (282)..(282): a, c, t, g, unknown or other
  misc_feature (282)..(282): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgagggtctcctgcaaggcttctggaggcaccttcagcgactatagtttacaattgggngcgacgggccctcgtggacaaggccttggacggtggagtggggaaggatcgtaccctagtcgttagacacaccaaacgtacgcacgagaacgtccgaggcagactcacactaaccggcgaactaaataacgaacactagtaactcgtaggacactacgaacacgcctgtactatcgtagacgacgcggacttcgtacgtctgtcgacgaggtactaattacgtaactacacgttacgtcctttaccttttacctaccttacccgttcggtacttccggtaccgggtcctaacggtccggtaaccccgttcccg

SEQ ID NO: 104628 - DNA, 589 bp, Homo sapiens
  misc_feature: GYAE6OF02GX7PS.17.34.D01.1.454.CMB.1.raw
  modified_base (285)..(285): a, c, t, g, unknown or other
  misc_feature (285)..(285): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcaaggcttctggaggctaccttcagcgactatacgttcaagttgggngcgacgggcctgtggacaagggccttgagtggagtgggaaggtatcgtccctatcggttgaccacaaccaaactacgacacgacgaagttccgagggcagactcacactaccgcggaactaactaacgaacactaagttaactcgtaggagtcgtacgaactagccttagtacatcgtagacggaccgtacggtccttacgttactcgttgtcgtacgagtacgtaattactatactactcgtcttccttttaccacccttccttacgtccttcggtcggtacctcgttaccggaccccgtccg

SEQ ID NO: 104629 - DNA, 595 bp, Homo sapiens
  misc_feature: GYAE6OF02GCFJR.17.34.D01.1.454.CMB.1.raw
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
tcagcgtagactagcacgaccggtgctcgatttagatcgtctgtgttgggtttggggacaaaacaaccagatttcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcacttcagcgacttatagtttcaagttgggngcgacgggcctcgtggacaaggtccttggagtggngtagggaagntcgtcctatcgtnacacaccaatcgcacagacgtcaggnagacncacacgtaaccgngaacaaatacgaacataagtacntggantacgaacacgcctgtntaacgtctaggagggacaccgggtctttacgtacttcgtgtcgacggaagttaacgttaaattacttaataactgtcgtccttttacccttttacgtaccctttaccttagtaccgtttacggtcgggtacctaggttacccgggaacccccgttcgtacccttacccg

SEQ ID NO: 104630 - DNA, 612 bp, Homo sapiens
  misc_feature: GYAE6OF02IHF71.17.34.D01.1.454.CMB.1.raw
  modified_base (264)..(264): a, c, t, g, unknown or other
  misc_feature (264)..(264): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgacaagtcgtggggctgaggtcgaagcgccgtgggtcctcggtggagggtctccgtgcgaaggtcttcgtggaggcacttnagcgactatagttcaagttgggtcgtcgacgggctcgtggacgaaggccttgagtggacgttgggaaggtctcgtcctagtcgtgacacacaactacgcacagaagtcgaggacagacacaccactaacgcgaacaaattacaanacgataanacgtagagctagaacacgcctgtactatacgacgaaggacgtacgggcttcttaccgtatcgtagtcggacgtaagtaacttacgtaacttaacacgtacgttaccttccctttttaacccgacctttacccgttcgttacgttacggttcggacccgtagtacccggtaacccgtaccggtacccgtttacccg

SEQ ID NO: 104631 - DNA, 625 bp, Homo sapiens
  misc_feature: GYAE6OF02GYWUA.17.34.D01.1.454.CMB.1.raw
  modified_base (325)..(325): a, c, t, g, unknown or other
  misc_feature (325)..(325): n is a, c, g, or t
  modified_base (421)..(421): a, c, t, g, unknown or other
  misc_feature (421)..(421): n is a, c, g, or t
tcagcgtagactagcacgaccggtgctcgatttagatcgtctgtgttgggtttgggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcggacgggcctctggacaaggccttgagtggatgggaagntcgtccctatcgttgacacaccaaactacgcacagaacttccgagggcagactcaccataaccgcgaacaacttaacgaacactagttaatcttanacgactagaacacgacctgtactacttcgtacgacggaccgacgggtcttaccgttacgtttccgtaggtcgacggtaggtacgttaattaactaacttaacctacgtacgttccctttaccgtttttaccctaacccgtttcccgttacgttaccgtttcggtacggggtcccctaacggttacccggaaccccggttacccg

SEQ ID NO: 104632 - DNA, 714 bp, Homo sapiens
  misc_feature: GYAE6OF02G9IFI.17.34.D01.1.454.CMB.1.raw
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (279)..(279): a, c, t, g, unknown or other
  misc_feature (279)..(279): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgaggtctctgcaggcttcgnggngcacctcgagcgactatagttcaagtttgggncggaccggcctcgtggaactaacgggtccttaggacgtgggatggggaaggtatcgtccctagttcgtgacaccaaccgaaactacgcacacgtacgttccgagggacacgactccgaaccataaacccggcgaaacgaaacgttaaaccgaaactaaccgtaagtttaaactacgtaggacgctaacggaacacggtacctagtacctatccgtaggaacggaaccgtaccgggtcttaccgttacgtttaccgttggtacgggaccgtaagggtaacttaaacgtttaacgtaacttaacaccgttaccggttccctttttaaccccgtttttaaacctacccccgttttaccccgtttaccgttacccggtttaccggttaccgggggtacccctttaaccgggttacccgggtaacccccgttaaccccgg

SEQ ID NO: 104633 - DNA, 573 bp, Homo sapiens
  misc_feature: GYAE6OF02HMLHL.17.34.D01.1.454.CMB.1.raw
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaagttgggtgcgacgggcctcgtggacaaggccttgagtggagtgggaaggatcgtccctagtcgttgacacaccaaactacgcacagacgtcaggcagacncacataaccgcgaacaaataacgaacacaagttaacnctaganctagaacagcctagtacatctagaggacgacggcttctacttctgtgacgagtagtaattatataacacgtacgttccttacctttttacctaccctttccgttacgttaccgtttccgttacgggtaccctacgttaccggacccccgttaccg

SEQ ID NO: 104634 - DNA, 899 bp, Homo sapiens
  misc_feature: GYAE6OF02FQJ03.17.34.D01.1.454.CMB.1.raw
  modified_base (280)..(280): a, c, t, g, unknown or other
  misc_feature (280)..(280): n is a, c, g, or t
tcagcgtagactagcacgaccggtgctcgatttagatcgtctgtgtttgggttttgggggacaaaacgaacccagattacctcctctaaagaagccccgtgggagcacagcctcatcaccagtggacctggacctggaggttcctctttgtggtggcagcagcttacaggtgtccagtcccaggtccagttggtgcagtcgtggggctggaggtgaagacgcctcgggtcctcggtcgagggtctccgtgactaaggcgttcgtaggaggcctaccgttnaggtccgtaacttattacgtttcgaaggttcggggtcgccggtaccgggtcccttcgtacggaaccgtaacggtcccgttttaggacggttgggaagttaggggtaacggaacgttccggtacccgtaagttaccggttttacgaaaaccgtacccgttaaaactccggacctaaccgaaggtaaacgtttcccggaagggtcctaacgtacctaccctaaccgtaaacgttaaaccccggtaccggtaaacccgtaaaaacgtttaaaccggaaaccgtaacgttaaacggtttaaacgttaccggttaacgggtaaggttaccgtttaacggtaaaccgttacggtacccgttacggtaccgtacggttaccggtacggaacccgggtaaccggtaccggggttaccgtttacccggtttaacgtttccggtacggttacggaccggtaacggtaacgtttaaacgtttaaccgtaaacgttaacccgtacgttacgtacccgttttacccgttttacccgtaccccgtttacccgtttaccgtacccgtttaccgttaccgggtcccttacggttacccccgggtaacccggttcccgtacccgttcccgtacccg

SEQ ID NO: 104635 - DNA, 935 bp, Homo sapiens
  misc_feature: GYAE6OF02IXZMN.17.34.D01.1.454.CMB.1.raw
tcagcgtagactagcacgaccggtgctcgatttagatcgtctgtgttgggtttggggatcgacaaaacaaccagattcctcctctaaagaagacccctgggagcacagctcatcaccatggactggacctggaggttcctctttgtggtgcagcagctacaggtgtccagtcccaggtccagttggtgcaatctggggctggaggtagaagacgcctgggtcctcggtgagggtcctcctgacgaaggtccttacgtagggacggtccaacccgtttcgaacggaccgtaaacttaacgttaacggttttaccgaaaacggttttcgggggtcgacccgggtaacccgggggtaccccttccggttaacgggaaacccgtaaagggggtccccgttttagggaacgggttacggggtaaacggttaaggggggtaaaacggtaacgttcccggttaacccccgttaagttccgggtttaccgaaccgtaaacccgtaaacccgtaaaaccgttaccggaacctaaaccggtaaacgggttaaaccggtttcccgaaaggggtaacctaacgggtaacccttccaaacccgttaacgtaaaaccccgggacggaaacctaaaacgttaaaccgaaacctaacgtaaagttaactacgtaagggacgtacgtaacgaacacgtaccgttacgtactacgtacttacggacggaaccgtacgggtacctttaccgttaccgttaccgttaggtacggtaaccggtaaaggttaaacggttaaacgtttaacgttaacgtaaccgtaacggtttaccggttaaccctttttaacccgtttttaaccgtaaccccgttttaccccgtttcggtttaacccgtttcccgggtaaccgggttacccgtttaacggtaccccgggttaacccccgttaccccg

SEQ ID NO: 104636 - DNA, 787 bp, Homo sapiens
  misc_feature: GYAE6OF02JIV78.17.34.D01.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaaggcgcctgggtcctggtgaggtctctgcaggcttcnggagcacttnagngactatagtttcaattgggtgccggtacgggcccttcgtggaccaaagggtcccttggaacggttggacgtggggaaaggtactccggttcccttacgtcgtttaggaccaccgaacccaaacttaccgccgtaacgtacgaacgtttcccaaggggcacgtacgtaccgacccgtaagtaaccccgacgggtaacctaaaacgtttaaacccgaaaaccgtaaccgttaaacggtttaaacgttccgtaaggggtaaccgtacgttaacggaaacccgtaacggtccccgtttaaggttaccctaagtacccgttagggaaacggaccgtaaaccggggttcctttaaccgtttaaccctttcggttaccggtacgggtacgaaacgggggttaaacttaaacgtttaaccgttaacgtaaccgtaaccggtaccgttaccgttttccctttttaaccgtacccttacccgtttacgttaccgtttaccgtcgggtacccgtacgttacccgggtaaccccggttacccg

SEQ ID NO: 104637 - DNA, 740 bp, Homo sapiens
  misc_feature: GYAE6OF02H6L2A.17.34.D01.1.454.CMB.1.raw
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagtttggtgcaatcgtgggctggaggtgaagacgccgtgggtcctcggtgagggtctcgtgcaggcttcgnggagcaccttnagcgatattagtttcaagttgggtcgcggaccggtcctcgtaggacgaacggtccgtaggaggtgggagtaggggaaggacgttccgtacccgtagtcgttacgaacctacaacctaaactacgactaacgaagtaacgttacgaggcagactacacctaacgtaacccgacggaaactaaacgttaaaccgaactaacgtaatttaacgtacgtagggacgtacgtacgaaacgacgtaccgtctacgtacgttacgaggaacggtaaccgtacgggtacctttacgttacttccgtaggtacgtaacggtaacggttaacgttaaacgttaaccttaaacgttaaccgtaccgttacgttacccttttaacccgttttaaccgtacccctttacccgttaacgttacccgtttaccgggttacgggtacccttaaccggttaccccgggttaacccccggttcgttaaccccgttccccg

SEQ ID NO: 104638 - DNA, 689 bp, Homo sapiens
  misc_feature: GYAE6OF02JMNPH.17.34.D01.1.454.CMB.1.raw
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (461)..(461): a, c, t, g, unknown or other
  misc_feature (461)..(461): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgttcccatcactacgcctttcggcctcgccttaggggtcactcaccctgccccgattacgttcggacaggacctggtcttccggcgngcgggctttcaccgctttacncgttactactgtcagcacttcgactcgttctcgtatacctccgtagcagtacgcctcaacgagtaccacctaccctttanacctacggtccttaacacgtaaccgacccttaccccctaacccctaaacgaaaccgtacaacgttaaacgccgtaccgtctaccggtcccgacgtaaacggtccgttcggttactcccgtacggtttagggtttaaccccggtccccgtttttacgccctttaacccgttttccccgggaaccttcggttacccttcgggtaaccctttaggtcccccgttaaccggg

SEQ ID NO: 104639 - DNA, 765 bp, Homo sapiens
  misc_feature: GYAE6OF02F5V1F.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtccaggtccagttggtgcaatctggggctgaggtgaagacgcctgggtcctcgggtgagggtctccgtgcaaggcttctgggaggcctaaccgttcaggcgacttagttagtttcaatttggggtagccggacgggtccctcgtggacaagggccttggacggtgggagtggggaaggcgtccgtacctagttcgttagacacgaaccaactacgcaacgagtaacgttacgagggacacggtactaccgaaccacgtaaacccggaccggtaactaaaacgttaaaccgaacgaacgtaagttaaactaccgtaggaacgtacgtaacgaaaccgtacgtacctagtactacgtacgtagtaacggtacgtaccgggtcttacgttacgtttacgtcggtacggacggtaaggttaagttaaccttaaacgttaacgttaaaccgtaccgttacgttacccgtttaacccgttttttaacccgtaaccccgttttaccccgtttaacggttacccgttttacccggttacccggggttaccgttaaccgggttaccccgggtaaccccccggttaccggtaacccccgtttaccccgg

SEQ ID NO: 104640 - DNA, 768 bp, Homo sapiens
  misc_feature: GYAE6OF02IKLTC.17.34.D01.1.454.CMB.1.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtcgcaatctggggctggaggtgaagaagccgtggggcctcgagtgaaggtctccgtgccaaggtcttctggattcctacgtttacctccgtatacgtatcaacgttgggtcgtcgccctaaggccngtacggacaaacgccgtgagttggagtggngtacgggtccgaaacctaacgacgtgggtgtaccacgtaagtcgttacttacccaacccgattccccggtacggacaaacggtacctttaaccgaacgttccggaacccaacgtaaacccgtacccttaacctaaacgttaaaaccaccgacggtaaccctaacgtaacgttaacggacgttacggaacggaacgtacccgttaacggaacctaacgttccgtacggaaaccggtaaccgacccgggttacccgttaacgttaacgtttacttcgggtacgttaaccggaacgggttaccgtaccccgaacgttaccggtacccgggtacggtaaaccggtcccgtaacgggtaccctaaccgggcccggtttaccgttttaccggtaacccgtttaccgggttcccgggggaaccctaacccggggg

SEQ ID NO: 104641 - DNA, 671 bp, Homo sapiens
  misc_feature: GYAE6OF02JK19Q.17.34.D01.1.454.CMB.1.raw
  modified_base (284)..(284): a, c, t, g, unknown or other
  misc_feature (284)..(284): n is a, c, g, or t
tcagcgtagactagcacgaccggtgctcgatttagatcgtctgtgttgggtttggggtacgaaaacaaccagattcctcctctaaagaagacccctgggagcacagctcatcaccatggactggacctggaggttcctctttgtggtggcagcagctacaggtgtccagtcccaggtccagttggtgcaatctggggctgaggtgaagacgcctgggtcctgggtgagggtctcctgcaaggcttctggaggcctaccttcagcgactatagtttcattgggtncggacgggcctctggacaaggtccttggagtggatggggaaggagtcgtcccttatcgtgacacaccaaactcgacacagtacgttccaggggcagactcaccagtaacccgacggaaccaaagtttaaccgaaaccaacgtaacgttaatacgtaggacgtacgtacgaaacgacgcctcgtactagtactaggacggacgtacgggtcctttagtaccttacgtcggttacggacggtaacggtagtttaaacttacgttaaactaaccgtacgttactacgtttacccgtttttaacccgtaccttcccgtttaccgtaccgtttacccggttcggggtaccccaagggttacccggtaaccccggttcctaacccgttccccg

SEQ ID NO: 104642 - DNA, 604 bp, Homo sapiens
  misc_feature: GYAE6OF02G036C.17.34.D01.1.454.CMB.1.raw
  modified_base (438)..(438): a, c, t, g, unknown or other
  misc_feature (438)..(438): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgaggggtctccgtgcaagggcttcgtgggaggcaccttcagcgactatagtttcaagttgggtgcggacgggcctcgtggacaaggccttgagtggatggggaagatccgtcctattcgttgacacaccaactacgcacagagttccaggcagactcaccactaaccgcggaacaaactaacgaacactaagttaatcgtagagctagaacngcctgtactatcgtgacggacgacggtcttactacttctgtcgacgtaacgtagttaacttacgtaactacacgttacgtcctttacccttttacctaccctttacccgtttacgtacctttccggtccggggtaccctacggttacccggtaccccggttacccg

SEQ ID NO: 104643 - DNA, 839 bp, Homo sapiens
  misc_feature: GYAE6OF02I8INV.17.34.D01.1.454.CMB.1.raw
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctccgtgacaaggcttcgtggacggcctaccgttcaggccgacttattaggttttacaagtttggggtcgacggaccggggtcccttacgtgggaacgaaacgggtcctttggaggttgggacgttaggggaaaggtacgttaccggttaccccttaagttccggtttggaaccaaccgaaaccctaaaaccgttaccggacctaaccgaaaggtaaccggtttccccgaaggggtaccaacggaaccttccgaaaccctaacgtaaaccccggaaccggtaaaactaaaacgtttaaaccgaacctaaaccgtaacgtttaaacgtaccgtacggaaacgtacgtaacggaaaccgtacggtacccgttagtacctaacgtttacggttacggaacgggaacgtaccgggttcctttaccgtttaccgtttacgttacgggttcgaccggtaagggttaaacgttaaacgtttaacgttaacttaaacgtacgttacgtttaccttttaccgtttttaacccttaccctttacccgtttccgttaaccgttttccgtacgggtaccttaccggttacccggtaaccccggttaccgtacccgtttcccg

SEQ ID NO: 104644 - DNA, 715 bp, Homo sapiens
  misc_feature: GYAE6OF02I64UZ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctggtcctggtgaggtctcctgcaaggcttcgtggacgcaccttcagcgacttatagtttacaagttgggtcgccggacgggtcctcgtggacgaaggtccttggagtggagtgggagtactcgtcctagtcgtagacactaccaaactacgacacagtacgtccgaggtcagacctacacacgaacccgcggaaactaaacgttaaccgaaactaactacgttaaactcgtacggagtacgtagaaacgacgtactagttaccacgttgtaacgacggtaccgtacgggttaccttacttaccgttcgttaggtacggtaccggtaaagggtaacgttttaaacgtttaaccgttaacttaaccctaacggttaccggttaacccttttttaaccccgtttttaaccctaaccccgttttacccctttaaccggttaacccgtttaccggttaccgggtaccccgtaaccggttacccccgggtaacccccgttaccccgg

SEQ ID NO: 104645 - DNA, 557 bp, Homo sapiens
  misc_feature: GYAE6OF02F38O7.17.34.D01.1.454.CMB.1.raw
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (454)..(454): a, c, t, g, unknown or other
  misc_feature (454)..(454): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgggtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggctctggacaaggccttgagtggangggaagatcgtcctagtcgttgacacacaaactcgcacagagtccaggcagactcacanaccgngacaaattacgaacacaagtaatctagagctagaacagcctagtcatctagagacgacggtacttctacttcngtcgacgaggattaattactatacgctcgtacctttacctttaccaccctttaccgttcgtactttcgtacgggtccctacgttaccggtaccccgttacccg

SEQ ID NO: 104646 - DNA, 706 bp, Homo sapiens
  misc_feature: GYAE6OF02JT3VI.17.34.D01.1.454.CMB.1.raw
  modified_base (231)..(231): a, c, t, g, unknown or other
  misc_feature (231)..(231): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (374)..(374): a, c, t, g, unknown or other
  misc_feature (374)..(374): n is a, c, g, or t
tcagcgtagactagcacgaccggtgctcgatttagatcgtctgtgttgggtttggggacaaacaaccagattcctcctctaaagaagcccctgggagcacagctcatcaccatggactggacctggaggttcctctttgtggtggcagcagctacaggtgtccagtcccaggtccagttcggtgcgaatcgtggggctggaggtgaaggacgccgtgggtcctcgggtagngggtctccgtgcaaggtcttcgtggaggtccaccgttcagcgactatagttcaacgtgggtgccggacggtcgtcgtaggacaaggtccgttagngtaggagtgggaagngtaccgtcctagtcgtcacgacaccaacgtacncaacgagtacgtccagggacagcctgacctaagaaccgacggtaacaaagttaaccaacgtacgtaataagtcctggaacgacgtacgaacgtagacccttaggtacacgttccgaaggtaacggggtactaaccgggtctttaccgttcgtaccttgggttacgcgtaaagggtacttaactaacgtactaacctagttccgtttactttcccgtttttaacctaccccggttacccttttaccgggtaacgttttacccgggttaccggggttaacctaaccggggtttacccggaacccccccggtttaccggtaacccccgtttccgg

SEQ ID NO: 104647 - DNA, 762 bp, Homo sapiens
  misc_feature: GYAE6OF02HV66G.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcgaaggcttcgtggaggccaccttcgagcgacttagtagtttcaagttgggtcgcggacgggtcttcgtaggaactaacggccttgacggtgtaagtgggaaacggctccggtaccctagtccggttagaaccgaacgtaacccgtaaacgtaccgaccgaacgaacggttaaacggttccccgaagggggtcaaacggtaccttaccgaaaccccgtaaaggtaaccccggtacggaaaccgttaaaaacttaaaccggaaacctacgtaaaccggtttaaacgtccgttaggaacgtcgtaaggaaccacggaccttacgtaccagtaccgtagaacggacgaaccgggtcttacttacgtcgtagtcgacgtacggtaaggttaaacttacgtaactaaccgtacgttacgtaccgttttaacccgttttaccgtaaccccgtttaccctttccggtttaacccgttccgggtacccggggtaacctttaacgggtaccccggtaaccccggtttaaccccgg

SEQ ID NO: 104648 - DNA, 841 bp, Homo sapiens
  misc_feature: GYAE6OF02GFGHJ.17.34.D01.1.454.CMB.1.raw
  modified_base (658)..(658): a, c, t, g, unknown or other
  misc_feature (658)..(658): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtggtacggtctcgtgacgtacggtcttcgtgggacggtcctaccgttgacggtaccgtaacgttaacgtttacggtttacgtaaggttttcggggacggtaccggggtaccgggtccgttacgggtacgggaaccggtaaccgggttccgttaggggacggttaggggtaacgggttaacgggggtaaacggttaccgtttaccccggtttacccgttacggttaccgggtttaccggaaaccctaaacccgtaaaacccgtaaaccgtacccggaacctaaaccggaacggttaaccggttacccgggaacggtaaccgaaccggtaacctaacccgaaaccgtaaccggtaaacccggaaccgggtaaacttaaaccgtaaaccggaaactacgttaaagttactacggacggtacgacgtaacggtaacncggtacctcgtactacgtacgacggtaaccggtacggtaccgttacttaccttacgttcgtggtacgaacggtacgtaaacgttaacttacgtaacgtacctacgttaccgttacctttaccgttaccgtcccttacgtacgttacgttcggaccgtacctcggtaccccgggtacctcccgg

SEQ ID NO: 104649 - DNA, 562 bp, Homo sapiens
  misc_feature: GYAE6OF02HKLQP.17.34.D01.1.454.CMB.1.raw
  modified_base (285)..(285): a, c, t, g, unknown or other
  misc_feature (285)..(285): n is a, c, g, or t
  modified_base (530)..(530): a, c, t, g, unknown or other
  misc_feature (530)..(530): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatctggggctgaggtgaagacgcctgggtcctcgggtggagggtctcctgcgaaggcttcgtggaggcaccttcagcgactatagtttcaattgggngcgacgggcctcgtggaccaaggcctgagtggagtagggaggatcgtcctatcgttagacacacaactacgcacaggaacgtccagggcagctacaccataaccgcgaactaaagttaacgaacacaagttaactctaggacgactagtaacagccttatctacgtctgacgacgacggtcttactacttcgtgtgcgtaggtagtaattagactacacgtgtcttacctttaccaccttccctntcttcggtcggcctagtaccggtacccgtccg

SEQ ID NO: 104650 - DNA, 832 bp, Homo sapiens
  misc_feature: GYAE6OF02GZ0I3.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgagacgcctcggtcgtcggtggtagggtcgtcctcgcgacggacgttctggaggcaccttcagcggacctatagtttctaattggtgcgacggccgtctggacgaaggccgttcgtagtggtagtaggggtaagggaacgtcgttccctacgtacgttcggtaactaaccgaaccctaaaccgttaaccgaccgaaccaacgtaaagttacccgtagggacgaacggaacctacctaacccgaacgttaaaccccggaaccggaacccgtaaaactttaaaacccgggaaacccctaaacgtaaaccggttttaaaacgtttacccgtacgggtaaaggacccgtttacgaaaacccgtaaacgggtcccttacggttaccgaactttacgttacggacgggtaaccggtaccggggtaccgttttacccttaaccgtttccgttccggttaggaccggtaaacgggtaacgtttaaacgtttaacttaaccgtttaaccaccgtttacggttccctttaacccggtttttttaacccaccccgtttaccccgttttcgtaacccggttttccgtaccgggggttaccccctaagtttaccccgggaaccccccggttttaaccccgg

SEQ ID NO: 104651 - DNA, 601 bp, Homo sapiens
  misc_feature: GYAE6OF02FUITQ.17.34.D01.1.454.CMB.1.raw
  modified_base (248)..(248): a, c, t, g, unknown or other
  misc_feature (248)..(248): n is a, c, g, or t
  modified_base (385)..(385): a, c, t, g, unknown or other
  misc_feature (385)..(385): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctgggtgagggttctcctgcaagggcttcgnggaggcaccttcagcgactatagtttcaattgggtgcgacgggcctgtggacaaggccttgagtggatgggagatcgtcctatcgttgacacaccaaactacgcacagaagttccaggcagctacacctataaccgnggaacaaattaacgaacactagtaactctaggagtactagaacgacgacctgtactatcgagaggacgacgggtcttctacttcgtgtcgacgtagtaagtaattaacgtaataacgacttacgtcctttaccgttttaacctacccttcccgttacgtacctttccggtacggggtacctacggtaccggtaaccccggttccaacccggttccc

SEQ ID NO: 104652 - DNA, 885 bp, Homo sapiens
  misc_feature: GYAE6OF02HHXJE.17.34.D01.1.454.CMB.1.raw
  modified_base (248)..(248): a, c, t, g, unknown or other
  misc_feature (248)..(248): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtggtcctcggtgagggtctccgtgcgaaggcttcgnggacgcaccttcagcgactagtagtttcaagttgggtgtcggacgggtcctcgtggacaacggtccttaggacggttggagtagggggaaacggtcgtccggttacccgtagttccgttacggaacctaccgtaacccgaaaaccgtaccggacaaccgtaacgggtaaacgtttacccgaacggggttaccgaacggtaaccctaccgtaaaccccgtaaacgtaaaccccgggaccgggtaaaaccctaaaaaacgttttaaacccgggaaaccctaaaacccggttaaacggttttaaaaccgttaacccgtttaaacggggaacgttaccgttaacgggaaaaccgtacggtacccgttacggtaccttacgttaccgtacgggaacggtaacccggtaccggggtttaccttaccgtttaaccgtttccgttacgggtacggtaaccgggttaagtaaacggttttaaacgtttaaaccgtaacgttaaaccttaccggttaccgttacctttttaaccccgtttttaacccgttaccctttacccgtttaccgtttacccgttacgggttacccgggtaccctaccggtttaccccgggaaacccccggtttcccgaccccgtttaccccg

SEQ ID NO: 104653 - DNA, 940 bp, Homo sapiens
  misc_feature: GYAE6OF02GEOV5.17.34.D01.1.454.CMB.1.raw
  modified_base (776)..(776): a, c, t, g, unknown or other
  misc_feature (776)..(776): n is a, c, g, or t
tcagcgtagactagcacgaccggtgctcgatttagatcgtctgtgttgggtttggggacaaaaaaccagattcctcctctaaagaagccccgtgggagcacagctcatcaccatggactggaccgtggacgttcctctttgtggtggcagcagcctacaggtcgtccagtcccaggtccaggtttggtcgcaatcgtcggggtctacggaggtagaacgaccggtcccgtacggggtcccttccgggtcggtacgggttcccttccgtcggtaccgtaaaccgggtcctttaccggtagggacggtaccctaccgtttacgacggtaccgtaacgttacgttacggttttaccgtaaaggtttcgggggtacggtaccgggtaacccggggtccccttaccggttacgggaaccgtaacgggtccccgtttagggaagggttcgggtaaggttacggggaaaagggtaccgtttcccgggttaccccttaaacggtttccggtttacgaaccgtaacccgtaaaccccgtaaaaccgttacccgacctaaaccggtaaacggttaaaccggtttacccggaacggggtaccgtaaccgtaacccttacccgaaaccgtaaccgttaaaacccgggacccggtaaaacctaaaacgtttaacccgggaaactaacgttaaacccgttaacgtaacgtagggtacgacttacgaaccgtacgtaccgttcgtacacgtttcgacggtacgtaccgtacggtctttaccgtaccttcgnggttacgacggtaagggttaacttaaacgttagtaaaccttaacgtacctaccgtttaccgtttccccttttaaccgtaccccttcccgtttacgtaccgttcccggttcgggttaccctacggtacccggtaacccccgttccgtacccttcccgtaccccgg

SEQ ID NO: 104654 - DNA, 757 bp, Homo sapiens
  misc_feature: GYAE6OF02H6OXE.17.34.D01.1.454.CMB.1.raw
  modified_base (261)..(261): a, c, t, g, unknown or other
  misc_feature (261)..(261): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttctctttgtggtggcagcagctacaggtgtccagtcccaggtccagttggtgcaatcgtgggctgaggtgaagacgccgtggtccgtcggtgagggtctctgacgaagcttcgtggaggccaccttcngcgactatagttactaagttggtgcggacgggcctcgtaggacaacggtccttagacggttggagtagggaaggacgtcgtcccgtatcgttgacaccgaccaaactacgacactagaacgtaccgagggtacaaggtacctaccgaaccaacgtaacccggacggtaaacctaaacgtttaaaccggaaactacgtaaacgtttaactacgtacggaacgtacgtacgaacgtacgtacctagttaccgattaccgtacggacggtacccgacgggtacccttttcgtaaccgtttcttacgggtgtaccgggtaaaggtaacgttttaaacgttaccgtaaagtttaaccgaccgtttacccggttaacccgtttttaacccctttttaacccgtaaccccgttttacccccgtttggttaaaccccgttttccgggttaccggggtacccctttaaacgggttaccccccgggttaacccgggttaccccccg

SEQ ID NO: 104655 - DNA, 611 bp, Homo sapiens
  misc_feature: GYAE6OF02I291R.17.34.D01.1.454.CMB.1.raw
  modified_base (248)..(248): a, c, t, g, unknown or other
  misc_feature (248)..(248): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgnggaggctacctcagcgactatagtttcaagttgggtgcggacggtcctacgtggaacaggccttggagtggatggggaagatcgtcctagtcgttagacaccacaactacgcacgacgagttccagggcagactcacataaccgcgaanaactaacgaacactagtaatctagganctagaacncgcctntactatcgtagagacgtacggtcttacgttacttcgtacggtcgacggtaggtaacgttaacttaacgtaacgttactacgttacgttactttaccttttaacctaccctttcccgttacgttacccgtttcggtccgggtacctaccggttaccggtaaccccggttacccg

SEQ ID NO: 104656 - DNA, 752 bp, Homo sapiens
  misc_feature: GYAE6OF02I1IM8.17.34.D01.1.454.CMB.1.raw
  modified_base (264)..(264): a, c, t, g, unknown or other
  misc_feature (264)..(264): n is a, c, g, or t
  modified_base (354)..(354): a, c, t, g, unknown or other
  misc_feature (354)..(354): n is a, c, g, or t
  modified_base (593)..(593): a, c, t, g, unknown or other
  misc_feature (593)..(593): n is a, c, g, or t
  modified_base (606)..(606): a, c, t, g, unknown or other
  misc_feature (606)..(606): n is a, c, g, or t
  modified_base (634)..(634): a, c, t, g, unknown or other
  misc_feature (634)..(634): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggactggagttctcttgtggtggcagcagctacaggtgtccgagtcccgaggtccaggttggtgcaatcgtggggctggacggtgaacgaccgccgtgggtccttcgggtggtagggtcctcgtagacgaacggtcttcgngggacgcctaccttcgagcgtaacttagttacgtttacaaggttggggtcgcggtaccgggtccttcgacggacgaacggtccgttaggnggtacgggtacggtagggggaaacggtccgttccggtaccctttaggttaccggtttacgaaacccaacctaaacccgaaaaccgttaccgacaaaccgtaagtaacccggttcggaacgggtacacggttaaccaccgaaccgtaacgtaaacccggcggtaaaactaaaacgttaaaccgaaactaacgtaaacgttaacgtacgacgggtaactaccgtaacgacgtacgttccgntacctagtaccgnggtacgcgtaccggtctttacttacgtntggtcgagtaggttaaactacttaacgtattacgctttacccttccgttttacccttacgttacccttacgttgttaccgttcgggttacggctaacccggtccgggtaccctcccgg

SEQ ID NO: 104657 - DNA, 548 bp, Homo sapiens
  misc_feature: GYAE6OF02FUCIA.17.34.D01.1.454.CMB.1.raw
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttctggaggcaccttnagcgactatagtttcaattgggtncggacgggcctcgtggacaaggccttgagtggatgggaagntcgtcctatcgttgcacacaactacncacagaatccaggcagactcacatacgcgacaataacgacactatatcagangagaactagccngtacactgtacgagacacggtacttcgtactctgtcgngagtagttaacttactaatacactgtaccttacttttacctaccttcccttacgtacttcgtcggtccgaagtaccggtacccggttccaccgttccg

SEQ ID NO: 104658 - DNA, 561 bp, Homo sapiens
  misc_feature: GYAE6OF02G2K7H.17.34.D01.1.454.CMB.1.raw
  modified_base (422)..(422): a, c, t, g, unknown or other
  misc_feature (422)..(422): n is a, c, g, or t
  modified_base (491)..(491): a, c, t, g, unknown or other
  misc_feature (491)..(491): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctctggacaaggccttagagtggagtgggaagatcgtccctatcgttgacacaccaaactacgcacagacgttccaggcagactcaccataaccgcgaacaaattaacgaacacaagttaatcgtagganctgaacagtacctgtacatacgtgacggacacgggcttacgtactctgtgcgaggataattactatacnctagtcttaccttttaccaccttcccttagtacccttcgtacgggtccacgttaccggtacccggtaccg

SEQ ID NO: 104659 - DNA, 733 bp, Homo sapiens
  misc_feature: GYAE6OF02G1BXP.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggatcctcttcttggtggcagcagctacaagtgcccactcccaggtgcagctggtgcagtcgtggggctggaggtgaagaagccgtggggcctcgagtgaggtctcctgcgaaggcttcgtggtacttctacgtttacctcctattagtactcaacgtgggtcgccgccgacggcccgcgtacggaaccaaccggtacctaggaggtagggagtgggagtcggggacccgtaaaccccgtaacgtacgttggtacgtacgaacgtaggttcgttaccttacccgaacccctacgttccccgtaccggggaacctaacggtacccttaaccgaacgttccgaaacccgtaacccgtaacccttccctaacccaaactaaaccaccgaccgtaccctaacgtacgttgggtaacgttaggaacggaccgtccgtagacctacgttaccgtacggaccgaccgacccgggtacctttacttaacgttacgtcggtacggaccggtacggtacccgtaccccgaacggttaccgtccgggttaacgaccggtacccgttacggcggtaccggtcccggtttaccggtttacgaccgtttccggggg

SEQ ID NO: 104660 - DNA, 577 bp, Homo sapiens
  misc_feature: GYAE6OF02FF10Y.17.34.D01.1.454.CMB.1.raw
  modified_base (386)..(386): a, c, t, g, unknown or other
  misc_feature (386)..(386): n is a, c, g, or t
tcagcgtagactagcacgaccggtgctcgatttagatcgtctgtgttgggtttggggatcacaaaaacaaccagattccctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccctgcaaggcttctggaggcaccttcagcgactatagtttcaatttgggtgcgacgggcctctggacaaggccttgaggtggatgggaagatcgcctatcgttgacacaccaaactcgacacagaacgttccagggcagactcaaccanaaccgcgaacaaattaacgaaacacataatcgtggagctagaacacgccttagtctatcctgaacggacacgggtcttacgttacttcttgtgacgaggtaagtaattaacttatactactacgtctttaccttttaacctacccttcccttagtaccttccgtcgggacctacgtcggaaccccgtcccg

SEQ ID NO: 104661 - DNA, 826 bp, Homo sapiens
  misc_feature: GYAE6OF02IE6G7.17.34.D01.1.454.CMB.1.raw
  modified_base (139)..(139): a, c, t, g, unknown or other
  misc_feature (139)..(139): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctntttgtggtggcagcagctacaggtgtccagtcccagtccagttggtgcatcgtgggctgaggtgaagccgtcgtgggtcctaggtgacggtctcctgctaaggtcttcgtggagtcctaacttcgaggtaccgtacttagttagtttcgtaagtttggggtcgacgtacggggtccttgtcggaactaacggtccgtttaggacggttaggacgtgggtaaacggtatcccggttaccttaagttccggtttaacgacgtaaccgaacctaaaacgttacggacctaacgaacggtaacgttcccgaaggggacctaacgccgttaaccaacctaacggtaacccggtaacgggaaacctaaaagttaaaccgaaacctaacgtaacggttttaaacgtaccgttagggtaacgtaccgtaacgtaaccgtacgttaccgttacgtacgtaacgtaccgttacggaacgggtaaccggtacgggttacctttaccgttaccgtttaccggtaggtaacggtacggttaacgggttaaacgtttaacgtttaacgttaacgtaaccgttacgttaccgtttaaccctttacccgttttttaaccgaccccgttttacccgtttaacggttcccttaccggggttcccggttaacccgtaccgttaccccgggtaaccccgttacccgg

SEQ ID NO: 104662 - DNA, 786 bp, Homo sapiens
  misc_feature: GYAE6OF02HMM5B.17.34.D01.1.454.CMB.1.raw
  modified_base (559)..(559): a, c, t, g, unknown or other
  misc_feature (559)..(559): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacaggtgtccagtcccaggtccagttggtgcaatcgtgggctgaggtgaagacgccgtgggtcctcggtggagggtctccgtgacgaacggtcttcgtgggacggtcctaccgttcgagcgtaacttagttagtttacgtaagtttgggacgccgggtaccgggtccttacggtacgggaacgtaacgggtccgttagggtaggtaggggtaacggttaggggaaacgtcgttaccgtaccgttagttcgtacgaacctaaccaaacctaacgtacgactaacgtaacggtaacgtccggaggtacaacggtacctacaaccgtaacgtaaccggacgtaaacctaaaacgtaaccgaaactaacgtaagtttaacacggttaaggacgtaacgtaggaaaccncggtacctacgtactacgttacggaggtaaccgacggtacgttccttacgttaccgttgtacggtacgtaacggaagttaagttaaaccttaacgtaacgtactaccgtttcgttaacccttttaccggtttaacctaccccgtttcttaacggttcccgttacgggtccgggtaccctaaccggttaaccccgggttaaccccgtacccgttacccggttaccccg

SEQ ID NO: 104663 - DNA, 636 bp, Homo sapiens
  misc_feature: GYAE6OF02F8619.17.34.D01.1.454.CMB.1.raw
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgagggtctcctgcaaggcttctggaggcaccttnagcgactatagtttcaattgggngcgacgggcctntggacaaggccttgagtggatgggaagatcgtcctatcgttgacacaccaaactcgcacagaagttccgagggtcagactcaaccactaaccgcggaacaaacgttaacgaacaactaagttaaactcgtaggacgtacgttacgaaacagtccgttagtacatacgtaggtaggaaccgtacgggtccttacgtaacctttcgtggtgaacggtaacggaagttaaattacgtaataaccgacgttacgtccctttaccgtttttaacctaccctttacccgttagtacccgtttaccggttcggggtaccctaggttacccggggtaaccccgttacccgg

SEQ ID NO: 104664 - DNA, 920 bp, Homo sapiens
  misc_feature: GYAE6OF02GXO87.17.34.D01.1.454.CMB.1.raw
  modified_base (188)..(188): a, c, t, g, unknown or other
  misc_feature (188)..(188): n is a, c, g, or t
  modified_base (277)..(277): a, c, t, g, unknown or other
  misc_feature (277)..(277): n is a, c, g, or t
  modified_base (451)..(451): a, c, t, g, unknown or other
  misc_feature (451)..(451): n is a, c, g, or t
tcagcgtagactagcacgaccggtgctcgatttagatcgtctgtgttgggtttggggagtcacaaaacaaccagattcctcctctaaagaagcccctgggagcacagctcatcaccatggactggacctggaggttccttctttgtggtggcagcagctacaggtgtccagtcccaggtccagttggngcaatcgtggggctggaggtgagacgccgtgggtcctcggtgagggtcctccgtagcaagggtcttcgtgggacggctaaccccgtttnacggccggaaccttaagttaggttttacctaaagttttgggggtcggtaccggtaaccgggggtcccttcgtggggtaacccaaagggtccgttttaggacggttgggtagtaggggaaaggacttccggtcccctaagttccgttaggaaccacctaacccaaaagtaccganaaccgtaacggtaaagtttcccgagggccgaagaaccctccggaaaccctagtaaaccccggacgggtaaaccctaaaaagtttaaccgaaaacccgtacgtaaacgggttttaaaactcccggttaagggtaaaggaccgttaacggaaaacccgaacggttacccgttaaggtaccgttaacgttaccgtaacgggtacgggtaaaccgaaccggggtttaccttacccgtttaaccgtttaccgtttcgggtacggtaccgggaacgggttaaacgtttaaaaccgttaccgttaaagttaaccccgttaacgttaaccgggttccctttttaaaccccgggtttttttaaccccctaaaccccctttacccccggttttaacgttaacccccggttttaccgggtacccggggtaccccgtttaaccgtttaccccgggggtaaacccccccggttttaaccccg

SEQ ID NO: 104665 - DNA, 635 bp, Homo sapiens
  misc_feature: GYAE6OF02IK2OB.17.34.D01.1.454.CMB.1.raw
  modified_base (183)..(183): a, c, t, g, unknown or other
  misc_feature (183)..(183): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (424)..(424): a, c, t, g, unknown or other
  misc_feature (424)..(424): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggngcaatcgtggggctgaggtgaagacgccgtgggtcctcggtgagggtctccngcgaaggcttcgnggacggcctaccttcgagcactaatagtttacaagtttgggngacggaccgggtcctcgaggacaacggtcctggagtggaggtgggagntcgtcctatcgtgacacacaactacgcanagacgtcgaggcagctacacacgaacgacgaacaaaactacgaacaactagttaacncgtacgaagtctaacgaactacgtcctaggtactactacgagacgacacgggtcttacgtacgttgtacgtcgaacggtagtaacttaaattactaaacttctaacgtcgtaccctttttacccgtttacccgtacccttaccggttaacgtccgttacggtcgggtaaccttacggtacccgggtaaccccgttacgtaccccgttcccg

SEQ ID NO: 104666 - DNA, 849 bp, Homo sapiens
  misc_feature: GYAE6OF02H2LIW.17.34.D01.1.454.CMB.1.raw
tcagcgtagactagcacgaccggtgctcgatttagatcgtctgtgttggggtttggggacaaaacaaccagattccctcctctaaagaagcccctgggagcacagctcatcaccatggactggacctggaggttcctctttgtggtggcagcagctacgaggtgtccacgtcccaggtccagttggtgcaatcgtgggctggaggtgaagacgccgtgggtcctcgggtgacgggtcctcctgcaggtcttcgtggagccaccgttcagcgtactattagtttacaagttgggtgcggtaccgggtcctcgtacgggaacgaacggtccttaggaggtacgggtaggttaggggaacggtagtcccggttaccgtaacgttccggttaccgaactaaccgaaacccgtaaaccgtaaccggactaacgaacggtaacgttccgaaggggtacaaggtacctacaaccaacgtaaacccggcgtaaacctaaaacgtttaaaccgaaacgtaacgtaaacgtttaacgtacgtacgggtacaccgttacggaaacgacggtacccgttagttaccgtacgttccggtacgggtaacgacccggtacgggtttccctttaacgtacccgttttcgtacgggtacggtaccgggttaaggtaaaccgttttaaaacttaccgtttaaaacgtaaccgtttaccgttacggtttaccccttttttacccttttaaaccggtaaccccctttcccggtttaaccgttaaccgggttttccccgggtacggggttacccgttacccgggttaacccccgggttaaccccggttccccggtaaccccgtttccccg

SEQ ID NO: 104667 - DNA, 675 bp, Homo sapiens
  misc_feature: GYAE6OF02I1CMX.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatctggggctgaggtgaagacgcctgggtcctcggtgagggtctctgcaaggcttctggaggccaccttcagcgatatagtttcaagttgggtcgcgacgggcctcgtggacaaggtccgttggagtggagtgggaaggactcgtcctagttcgttgacacgaccaaacgtacgacacagagttaccgaggcagactccaaccacgtaacccgacgggaactaaactaaacgaaacaacgtaagtttaatacgtaggtagacgtacgaaccagtacctcgtacgactacgtacgacggacgtaccgggtctttaccgttacgtttcgttcggttgtaccgtaaggtaacgttaaactttacgtaacttaaccgtacctaggttcccttttaacccgttttttaaccctacccgtttaccccgtttacgttaccgtttccggttaccgggtacccgtaacggttacccgggtaacccccggtaccccg

SEQ ID NO: 104668 - DNA, 750 bp, Homo sapiens
  misc_feature: GYAE6OF02JK8W8.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccagttggtgcaatcgtggggctggaggtgaagacgcctgggtcctcggtgacgggtctctgcaaggcttctggagctaccttcagcgactatacgttcaaattgggtgcgacgggtcctcgtacggacaaggcctttggaaggttcggagtagggaaggtctcggtccctatcgttgaacacgaaccaaacgtacgacgtaacgacgaaacgttccgacgggtacacggtaaccttacaacccgtaagtaaaccccgcgggtaaacctaaaacgtttaaaccgaaactaaacgtaacggtttaaacgtaccgtaggtaacggtactacgtaaacacggttaccgtagttacccgtaacgttactacgggaaggtaacccaacgggggttaccctttacgtttaaccgtcgttacgggtacggaccgttaacgggtaacgtttaaaattaaccgtttaactaacgtacgtaccgttaccgttttacctttttaaccgaccctttaccccgtttagacccgtttacggttccgggtacccgtacggttaccccggttaaccccggttaaccccgg

SEQ ID NO: 104669 - DNA, 812 bp, Homo sapiens
  misc_feature: GYAE6OF02GYERD.17.34.D01.1.454.CMB.1.raw
  modified_base (260)..(260): a, c, t, g, unknown or other
  misc_feature (260)..(260): n is a, c, g, or t
tcagcgtagactagcacgaccggtgctcgatttagatcgtctgtgttgggtttgggacaaaacaaccagattcctcctctaaagaagccccctgggagcacagctcatcaccatggactggacctggaggttcctctttggtggtggcagcagctacaggtgtccagtcccaggtccagttggtgcaatcgtggggctggaggtgaagcgcctgggtcctcggtgagggtctcctgcgaggcttcgtggacgctaccttnagcgactattagttctaagttgggtgcgacgggtcctcgtaggacgaaggtccttaggacggtggagtagggaaggtacgtcccggttacccgttagttccggttacgaacctaaccgaaccctaaaaccgtaccggaccaaccgtaaggtaaccggttaccgagggtaccaacgtaccctaccaaccgtaaccgttaaccccggacggtaaaacctaaacgtttaaaccgaaacctaaacgttaacgtttaaacgttacggtaacgggtaacgtaccgttaacggaaaccgtacggtacccgttaggtaaccctaacgttaccgtacgggaaccggacccgggtacccgggttaccttttacccgttaccgtttaccgttggttaccggacggtaaggtaacgtttaacgtttaaactaaaccgttaacgtaccgttccgtttaccttttaaccccgttttaccctaacccgtttcccgttacgttaccgtttacggtcgggtaccctaccgggttacccgggtaacccccgttaccgtacccgttacccg

SEQ ID NO: 104670 - DNA, 706 bp, Homo sapiens
  misc_feature: GYAE6OF02H4BIQ.17.34.D01.1.454.CMB.1.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (378)..(378): a, c, t, g, unknown or other
  misc_feature (378)..(378): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggacggttcctctttgtggtggcagcagctacaggtgtccagtcccaggtcctagttggtgcaatcgtggggctgaggtgaagacgcctgggtcctcggtgaggtcctctgcaaggcttnggngctacttnagcgatatagttcgaattgggngcggacggctcgtggacaacggtcttggagtggagtagggagatcgtacctagtcgtgacaccaaccaactacgcacagacgtcgaggcagactanaccaacgtaaccgacgaactaaagtaacgaactacgtaacgtttaacacgtagtaacgcgtaagaaaccaggttcctacggtacacgttacggtacggaacggaaccgtcgggttcctttaacccggtaagttttccaggtaccggtaaccgggtagtaaaacgttttaaacttaacccggttaaataacccggttacgtaccgtttaaccccgtttttacccttttaacccgggttaacccccttttcccggtttaaccgtttaccgtttaccccgggtaaccggggtcccctaacgggtttacccccgggtaaccccggttacccg

SEQ ID NO: 104671 - DNA, 670 bp, Homo sapiens
  misc_feature: GYAE6OF02JBKW1.17.34.D01.1.454.CMB.1.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctccgtgcaggtcttcgtggagcaccttcgagcgactatagttcaattgggtgcgacggcctcgtgacgaggcctgagtggagtggaggntcgtcctgtcgttgacacaccaactaccgacacaagaacgttaccgagggtacagactacaaccaacgaaccgacggaactaaacgttaacgaaacaacctacgttaactcgtaggacgtacgtagaaaccgtagacccgtacgtactacgtccgtaggacggacgaccggtccgttacgttaccgttacgtggtacgacggaacgggtagttaaccgttaactaagttaacctacgttacgtacctttaccgttttaacccttacccgttacccttaccgtaccgtttccggtccgggttacctacggttacccgggtaccccggttacccgtacccgttacccccg

SEQ ID NO: 104672 - DNA, 939 bp, Homo sapiens
  misc_feature: GYAE6OF02JCO7K.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcatctggggctgaggtgaagacgccgtgggtcctcgggtggacgggtcctccgtggacgaacgggtccttcgtagggacggcctaccgttcgaggtaccgaaccgttagttaaggttttacctaaaggttttcgggggtacgtaccgggaaccggggttccccttcgttacggggaaccgtaaacggggtccccgtttagggaaggttcggggaaggttacggggggaaagggtaccgtttacccggttacccccggttaagtttccgggttacggaaccgtaacccgaaaccccgttaaaaaccgtaacccggaccctaaaccggaaccggttaaaccggtttaccccgggaaggggacccgtaacggtaaccccgttaaccgtaaacccccgaaacgggttaaaacccccggaaccgggtaaaaccgtaaaaccggttttaaaaacccgaaaccgttaaacgttaaaggtttaaaacccggttccgttaacgggaaacgttaacccgtaacggtaaacgtaccgtcccgttaagtaaccgtagttaccggtagggacggaacccggttaacggtactttacccttacgtttacgtcgggttacgaccgggtaaggttaacgttaaacgttactaacgttaccgtacgtacgtttcccgttttaacccgtttaaccaccccgtttccgtttacgtacccgtttacgggtccggttaccccgtaagttaccccgggtacccccggttaaccc

SEQ ID NO: 104673 - DNA, 690 bp, Homo sapiens
  misc_feature: GYAE6OF02GCFQ0.17.34.D01.1.454.CMB.1.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaagtctggggctggaggtgaagacgccgtgggtcctcggngagggtctcctgcaagcttcnggngctaccttnagcgactatagtttcaagttgggtncgacggtcctgtgacaaggccttgagtggactgggaagatcgttcctatcggttagacacgaccaaactcgcacagtaacgttccgagggtacaggtaacctccgaaccaacgttaacccggaccgggtaaactaaaacgtttaaaccgaaacgaactaacgttaaactcgtaggaacgtacgtagaaccgtagacccttagtaccgtaactcgtaggtaacggacgtaccgggtacttacgttacttcgtaggtcgtacggtagtaacgttaaagttaacttaataaccgtactacgtaccgtttacccttttaaccgttaccctttcccgtttaccgttaccggttaccgggtaccttacggtaccccggttaccccggtacccgtacccggttcccttaccccg

SEQ ID NO: 104674 - DNA, 565 bp, Homo sapiens
  misc_feature: GYAE6OF02IWOFF.17.34.D01.1.454.CMB.1.raw
  modified_base (251)..(251): a, c, t, g, unknown or other
  misc_feature (251)..(251): n is a, c, g, or t
  modified_base (332)..(332): a, c, t, g, unknown or other
  misc_feature (332)..(332): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtggagggtcctcctgcaaggcttcgnggaggccaccttcagcgactatagtttcaagttgggtgcggacgggtcctcgtggacaaggccttggagtggagtgggagntcgtcctagtcgttgacacaccaactcgcacagacgttcgaggcagactcaccataaccgcgaactaataacgaacactagtatcgtagagactagaacacgcctagtcagtctacgagacgacggtcttctacgttcgtgtcgagtagtagttaacttatactactacgtcgtcctttacctttaccacccttccttacgtacgttcgtcggtcctacgtccggacccgtcc

SEQ ID NO: 104675 - DNA, 644 bp, Homo sapiens
  misc_feature: GYAE6OF02FHBR1.17.34.D01.1.454.CMB.1.raw
  modified_base (345)..(345): a, c, t, g, unknown or other
  misc_feature (345)..(345): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagaagcctggggcctcagtgaaggtcctcctgcaaggcttcgtggattcacgtttacctcctatagtatcaactgggtgcgccaggccgctggacaacgacctgagtggatgggatgggaccaaccctaacacgtggtntcacagttgtccttcaccctatcccgtcgggacagactttaccatcgaccacgaactcctaccaataaaccacacgccctaacagttaggagttgaagggtacgcccttaggacctagttccgtacggtaaccgaccgaccgggtcccgttacttaacgtttaccgtggttacgaccggtaacggaccgttaccccgacggacgtcccgggttaggaccggtaccccgttaacgggccgaacgggtcccggttaccgttttacggaccttttccgggtcggggggaccctaacgggggg

SEQ ID NO: 104676 - DNA, 691 bp, Homo sapiens
  misc_feature: GYAE6OF02HACJH.17.34.D01.1.454.CMB.1.raw
  modified_base (500)..(500): a, c, t, g, unknown or other
  misc_feature (500)..(500): n is a, c, g, or t
tcagcgtagactagcacgaccggtgctcgatttagatcgtctgtgttgggtttggggatcacaaaacaaccagattcctcctctaaagagcccctgggagcacagctcatcaccatggactggacctggagttcctctttgtggtgcagcagctacaggtgtccagtcccgaggtccaggttggtgcatcgtgggctgagtgagcgccgtggtcctggtgacgggtctccgtgcgaggtcttcgtggattcacgtttacctcgtatagtactcaacgtcggtcgccgcgtacggcccgtcgtacggaaccaacggtaccgtggtaggtaggtacgtcgggtacgtcggggacctaaacccgtaacgacgttcgggtacgtacgaacgtcggttacgttcccgtacctaacccgtcgttacccggtttaccgggaacctaacggtacccttaacgacgttaccgaacccgtaccgtacctacccgtaccaacgtaaaaccnctacgtaccctacgcgtaggtacgtcgacgcgtaccgtcgacgtactcgtaacgcgtaaccgacccggtcgttacgtaccgttagtcggcgtacgacgacccgtaccgaccgtacgtaccggtcgaaccggtccgtaccggcgcggttcccggtccgttacggtccgttccggtcggcccggtaggtcccg

SEQ ID NO: 104677 - DNA, 1044 bp, Homo sapiens
  misc_feature: GYAE6OF02HYRKW.17.34.D01.1.454.CMB.1.raw
tcagcgtagactagcacgaccggtgctcgatttagatcgtctgtgttgggtttggggatcacaaaacaaccagattcctcctactaaagaagcccctgggagcacagctcatcacatggactggacctggaggttcctctttgtggtggcagcagctacaggtcgtccagtcccaggtccagttggtgacatcgtgggctgaggtagagacgccgtgggtacctcggtgacgggtctccgtgacgaaggtcttacgtgggaggcctaccgttacgacggacgtaacttaacgttaacggttttctaaacgtttcgggggtacggtacgggtaacccggggtcccctttacggtacggggtaacccgtaaaacggggttccccgttttagggtaagggtttaccgggggtaaggtttacggggggggtaaaaacggtacgttttaccccgggtttacccctttaaacggtttacccgggtttttaccggaaaaccctaaccgtaaaacccccgtaaaaaccgtttaacccgggaacccgtaaaccggtaaaaccggggttaaccggttttaacccccggggaaaggggggtaccctaaaacccgggtaaaccgtttaacccccgaaaccccggttaaaacggttaaaccccccgggggacggtttaaaaaccgtaaaaaaccgttttaaaaaccggtaaaaccctaaaacggttaaacggtttttaaaaccgtaaccgggttaaagggggtaaaccgttaaccggttaaacggaaaaccggttaaccggttacccggttaacggtttaccgtaacgttaccggtaacggtaaacgggaccggttaacccgggtttacctttaccgtttaaccgtttcgtacgggttaccggacggttaacgggtaaacgtttaaacttaagtaaccttaacgtacgttaccggttaccctttaacctttttacccgtacccgtttacctttacccggttctttaccggttaccgggttacccgtaacggttaccccgggtaacccccggttaccg

SEQ ID NO: 104678 - DNA, 805 bp, Homo sapiens
  misc_feature: GYAE6OF02H13U2.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccagttggtgcatcgtggggctgaggtgaagacgcctgggtcctcgggtgagggtctccgtgcgaaggtcttcgtggacggccaccttcgagccgacctaattagtttcaagtttggggtgaccggaccgggtccttcgtaggaacgaacggtccgttggacggtagggagtaggggaaggtacttacccggtcccgtagtccggtttacgaccaacccgtaaccgaaaccgtacgtaccacgtaaacgtaacggttcccgaagggacctaacggtacctacccgaaacccgtaaaccggttaaacccggaccgggtaaacctaaaacgtttaaaccgaaaccgtaaacctaacggtttaaactaccgtaagggacgtaccgtaacgaaaccgtacgtacccgttacgtacttacgtccgtaagtaaccgggacccggtaacgggttcccttttaccgtaccttttacgtacgggtacgtacgggtaacggtaacgtttaaacgtttaacgtaacttacgtaccgtttcgttaaccttttccccgttttaacgtaccccttttaccgttacgttacctttaccgggtcccggttacccgtacggttacccggttacccccgttacccgg

SEQ ID NO: 104679 - DNA, 843 bp, Homo sapiens
  misc_feature: GYAE6OF02GGXJX.17.34.D01.1.454.CMB.1.raw
  modified_base (285)..(285): a, c, t, g, unknown or other
  misc_feature (285)..(285): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcgggtgagggtctccgtgcaaggtcttcgtggacggcaccgttcagcgactatagtttcaattgggancgacgggcctcgtggacaaggtccctttggaggtcggagtaggggaagacttccggtacccttaagtccgttggaacctaccgtaacccaaaacgttccgaccaacgaacggtaacggtttccgacgggggactacggaaccttaccgaaccaacgttaaacccggcgggaaactaaaattaaacccggaactaacgtaagttaaactcgtaggaacgtcgttaagaaaccgtacgtacccgtaggtacctaagttaccgtacgggaacggtaaccgtaaccgggttaccgtttaaccgttaaccggttccgtttacggtaacggtaccgggttaaaggggtaacgtttaaaacgtttaaaccggtttaaaactaacccggttaaccttacggttaccccgtttttaaccgttttttaaccccgaaacccctttttcccccgtttaacggttaacccggttttaccgggttacccgggggttaacccctttaaccgggttaacccccgggggtttaaccccccgggttaaccggttaacccccgggttttaccccccg

SEQ ID NO: 104680 - DNA, 630 bp, Homo sapiens
  misc_feature: GYAE6OF02IKPIU.17.34.D01.1.454.CMB.1.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctctaggacaaggccttgagtggagtgggaagntcgtcctatcgttgacacaccaaactcgcacagaacgtccagggcagactcaaccataacccgcgaacaaacttaacgaacaactagttaatactaggaagctagaacagccttagtacatcgtagaacggaccgtacgggtactttaccttaccgttcttggtacgtacggtaagggtaagttaaacgttaacttaacgtaactaccgttacgtacccttttacccgtttttaacctaccctttccctttacgtaacctttccggtacgggtacccttacgttacccggtaaccccgttacccg

SEQ ID NO: 104681 - DNA, 891 bp, Homo sapiens
  misc_feature: GYAE6OF02F5IS0.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttgttgcaatctgggctgaggtgaagacgcctgggtcctcggtgagggtctccgtgacaggcttctgggacggccacctcagcgactatgttacaagttggtgcgacgggctcgtaggactaaggcttggaggtggagtaggggaagagtccgtacccttagtcgttagaaccgtaacaacccgtaaacgtaccgacaacgtaacgtaagttacccgagggtacaacgaacctacccaaaccgtaaaccgtaaacccggaccggtaaaaccgtaaaacgtttaaaacccggaaaaccctaaacgttaaaacggtttaaacctaccggttaacgggtaacgtaaccgttaacggaaaaccgtaaccggtttcccgtaacggtttaccgtaacgtttaccggtaacggggtaaccggggtaaacccggtaaccgggggtttaccctttaacccggtttacccggttttaccgtttacggttacggggtaaccgggtaacgggtaaacgttttaaaccgttttaaaccgttaacctttaaacccgtaaccggttacggtttaacccgttttttaaccccgtttttttaaacccccgttacccccgttttaaccccgtttttaccggtttaacccggttttaccccgggttccgggggttaaccccgttaacccggtttaaccccggggtaaccccccccggttttaccccgg

SEQ ID NO: 104682 - DNA, 747 bp, Homo sapiens
  misc_feature: GYAE6OF02GOGA0.17.34.D01.1.454.CMB.1.raw
  modified_base (250)..(250): a, c, t, g, unknown or other
  misc_feature (250)..(250): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcgggtggagggttctcctgcaaggtcttcgnggaggcctaccttcagcgaactattacgtttcaagtttggggtgcggaccgggctcgttggacaaggtcccttaggaggtaggagtcggggaaaggtcgtccgtccctatcgttacgacaacgaaccaactacgccaagagaacgttaccgagggacaacggactacgaacctaacgtaaacccggccggaaactaaaaccgttaaacggaacctaactaaacggttaactaccggtaggacgtacctacgaaaccgtagtacccgtgttacgtacttacgttagacgggacgtaccgggtctttaaccgttacgtttccgttagtcgacgggtaacggtaagttaacttaaccttaattaaccgtacttacgttaccgttttcctttttaaacccttaccccttacccgtttccgtttaaaccgtttcggttaccggggttacccgttaccggttaaccccggggttaccccgttaccgacccccgtttaccccgg

SEQ ID NO: 104683 - DNA, 618 bp, Homo sapiens
  misc_feature: GYAE6OF02FIMX7.17.34.D01.1.454.CMB.1.raw
  modified_base (385)..(385): a, c, t, g, unknown or other
  misc_feature (385)..(385): n is a, c, g, or t
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcttcgtcatcacgcctcagccttgatttttccggatttgcctaggaaaaccagcctacccgcttaaaccgggacaaccgtcgcccggccaacatagccttctcccgtcccccttcgcagtaacaccaagtacaggaatattaacctgttcccatcgactacgcctttcggcctcgccgttaggggtcactcaccctcgccccgattaacgttgacagtacccttgtcgtccggcgagcgggtcttttcacccgtntttactcgttacttatgtcanctattcgcactctgactacctcagcatcgcctcacncgaccacctaccttcaccgacgtacttaaccgacgaacccgccttacccccaacccaacaaccgcaacgtacgcgtacgcgtcggaccgcacgtcttcggcgtactagttcggtttaccgtcccgtttctaccgttccgttccccgactacttccgtacgtacttacgtacctacg

SEQ ID NO: 104684 - DNA, 715 bp, Homo sapiens
  misc_feature: GYAE6OF02I4JF7.17.34.D01.1.454.CMB.1.raw
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaacgacgcctgggtcctggtgaggtctctgcaggctanggagcactnagcatatnttcattggncgacggctntggacacggccttggagtcggagtgggaagctcgtaccgtatcgtcgaacaccaaccaacgtacgacaacgagtacgttaccgacgggtacaacggactaccgaactacgtaacccgacgggaaacctaaaagttaacgaacctaacgaacgtttaacgtacgtacgggacgtacgtaacgtaaacgacgtaccgtacgttactaacgttactacgggaacgtaccgtacgggtcttaccgttaaccgttacgtacggtacggtacggtaacgggttaacgttaaacttaacgtaaacgttaaccgttaacgtcggttacccttttacccgtttaacccgttacccgttacccgttaccggtttaaccgttaccggttacgggtaccccgtaaggttaccccgggtaacccccgtttaccgtaccccgtttaaccccgg

SEQ ID NO: 104685 - DNA, 588 bp, Homo sapiens
  misc_feature: GYAE6OF02FQZRN.17.34.D01.1.454.CMB.1.raw
  modified_base (324)..(324): a, c, t, g, unknown or other
  misc_feature (324)..(324): n is a, c, g, or t
  modified_base (445)..(445): a, c, t, g, unknown or other
  misc_feature (445)..(445): n is a, c, g, or t
  modified_base (498)..(498): a, c, t, g, unknown or other
  misc_feature (498)..(498): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttgagtggatgggaagntcgtcctagtcgtgacacaccaaactacgcacagacgtcgagggcagactcaccataaccgcgaacaaataacgaacactaacgttaatcgtaggacgctagaaccagcctcgtacattcngacggacgacggtcttctacttcgtgtcgacgagtaagttaacttacaatacncttacgtcctttacccttttaaccaccctttcccgttacgttaccgtttcggtccgggtaccgtacgttacccgggtaaccccggtcccg

SEQ ID NO: 104686 - DNA, 611 bp, Homo sapiens
  misc_feature: GYAE6OF02FVHLR.17.34.D01.1.454.CMB.1.raw
  modified_base (356)..(356): a, c, t, g, unknown or other
  misc_feature (356)..(356): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctcgtggacaaggccttgagtggatgggaagatcgtcctatcgtgacacaccaaactacgcanagaacgttcgaggcagactcacataccgacgaacaaataacgaacactagtaatcgtaggagtactagaacgacgtcctagtacatcgtagacggacgtacgggtccttacgttacttcgtacggtcgtacgaacggtaagttaacttaactaacgttactacgtacgttccctttaccttttaccctaaccccttccgtttacgtacctttcggtaccgggtcctaacggttacccgggtaaccccgtacccgg

SEQ ID NO: 104687 - DNA, 655 bp, Homo sapiens
  misc_feature: GYAE6OF02FVPOO.17.34.D01.1.454.CMB.1.raw
  modified_base (285)..(285): a, c, t, g, unknown or other
  misc_feature (285)..(285): n is a, c, g, or t
  modified_base (327)..(327): a, c, t, g, unknown or other
  misc_feature (327)..(327): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggacggcaccttcagcgactatagtttcaatttgggngcgacgggcctctggacaaggtccttgagtggagtgggaagntcgtcctagtcgttgacacacaactacgcacagtaacgttccgagggacagactacgaccaacgtaaccggcgaactaaacttaacgaacaactaagttaactacgtaggacgactagaacacgtacctgtactacgtacgtgacggtaccgaccgggtccttaccgttaccttcgtcgttcggtacggtacggtaacgttaactttaacgtaacgttaaccgtacgttacgttctttaacccctttttacctaaccccgtttccctttacgttacctttccggttaccggggttaccctacggttacccggtaaccccggttacccg

SEQ ID NO: 104688 - DNA, 834 bp, Homo sapiens
  misc_feature: GYAE6OF02G6ENJ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatcgtggggctgaggtgaacgacgccgtgggtcctcgggtgacgggtcctccgtgacgaacggtcttcgtgggacggtcctaccttcgaggccgacttagtacgtttacaagtttgggtcgccggtaccgggtcctcgtagggacgtaacggtccgttaggacggttgggaagtagggggaacggtacgttcccggtcccgttagttaccggtttacgaaccaaccgtaaccccgtaaaacgtccgtaaccgaaccgtaacgtaaccgggttaccgaacgggtaccgtacggtacctacccgaaaccgtaaccgttaaaccccgggaccgggttaaacctaaaaccgttaaaccgaaaccgtaaccgttaaacgttaaacgttaccgtacggtaacgaaccgttaacgaaacctcgtaccgttacgtactacgtaccgtagtaccgggaacgtaccggttacttaccgttacgtttcgtcgggttacgtacgtaagggttaacgtttaaactttaacgttaaccgttaaccgttacggttaccctttccgttttaacccctttaaccttccccgtttacccttacggtttccgtttaccggttccgggtaaccttaccggttaccccggtacccccggttacccgg

SEQ ID NO: 104689 - DNA, 626 bp, Homo sapiens
  misc_feature: GYAE6OF02FGIYV.17.34.D01.1.454.CMB.1.raw
  modified_base (324)..(324): a, c, t, g, unknown or other
  misc_feature (324)..(324): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatctggggctgaggtgaagacgcctgggtcctcgggtgagggtctccgtgcaaggcttctggagcaccttcagcgactatagtttcaattgggtgcggacgggcctctggacaaggccttgagtggatgggaaggntcgtccctatcgttgacacacaaactcgcacagaagttccagggcagactcaccataacccgngaacaagtaacaanacagttaatctaggacgtctagaacagtcctgtctatcgtagacggaccgacgggtactttccgttacttcgttacgtcgtacggaaggtacgttaaacttacgttaataacctacctacggttcccttaccgtttttaaccctaccccgtttaccctttaggtaccttttaccggtaccggggttacccgtaacgttacccgggttaaccccccggttacccgg

SEQ ID NO: 104690 - DNA, 899 bp, Homo sapiens
  misc_feature: GYAE6OF02G3UIQ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgcaatcgtggggctggaggtgaagacggccgtgggtcctcggtggtagggtcctccgtgcgaacggtcgttcgtgggacggcctaccgttcgagtccgtaactacgttagtttctaagtttcgggtacggacggtaccgggtcctcggtacgggaaccgtaacgggtccgttaggtacggtagggaaggtaggggtaaacggtccgttacccggttacccttaacggtttccggttacgaaccgaaaccgtaaacctaaaaccgtaccgaaccgtaacgtaaacggtaacggttaccggacgggaaccgtaaccgtaaccgtaaccctaaaccggtaaaccgtaacccggtaaaccgtaaaaccgttaaaacctaaacccggtaaaaccgtaaacgttaaaacgtttaacggtacggttacgaaccggtaacggtaaaccggaaccggtaccgttaccgttaacgtaccgttacgtaccgggttaacggaacccggtaaccgggttaccgttaccgtttaacccgtttcgttaccggttaggtaaccgggtacggttaaacggttaaaacgtttaacgtttaaccaaccgttaccgttaccgttaccgttaaccccgtttttacccttaaccgttacccctttaccgtttaccgtaaccggttccgggtaaccggtaccgttacccggtacccggtaacccccgttacccgg

SEQ ID NO: 104691 - DNA, 165 bp, Homo sapiens
  misc_feature: GYAE6OF02HDL42.17.34.D01.1.454.CMB.1.raw
  modified_base (164)..(165): a, c, t, g, unknown or other
  misc_feature (164)..(165): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggagttcctctttgtggtggcagcagctacaggtgtccnn

SEQ ID NO: 104692 - DNA, 591 bp, Homo sapiens
  misc_feature: GYAE6OF02GC2P4.17.34.D01.1.454.CMB.1.raw
  modified_base (427)..(427): a, c, t, g, unknown or other
  misc_feature (427)..(427): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgacaaggtcttcgtggacggcaccttcagcgactatagtttcaagtttgggtgcggacgggcctctggacaagggtccttggagtggagtgggaaggctcgtcctatcgtgacacaccaaactcgcacagacgtcgaggcagactcacataccgcgaactaaataacgaacactaagttaatcgtagganctagaacacgcctagtcactcgtacgacggacgacggtcttacgtacttcgtggtacgcgtagtaacgttaacttactaatacactcgtcctttaccttttacctacccttaccgttacgtaccgtttcggtcgggtacctacggttaccggacccgttacccg

SEQ ID NO: 104693 - DNA, 617 bp, Homo sapiens
  misc_feature: GYAE6OF02F21DM.17.34.D01.1.454.CMB.1.raw
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggctaccttnagcgactatagtttcaagttggngcggacgggcctcgtggacaaggccttggacgtggatgggaagntcgtcctatcgttgacacaccaaactcgcacagtaacgttcgaggcagactcacactaacggcgaacaaataacgaacacaagttaatacgtagacgtacgtagaacacgcctgactatcgagacgacgacgggtcttacgtacttcgtcgtacgtacgtaaggacgttaattacgtaataacctacgttacgttacctttaacctttttaccctaacccgtttaccctttacgtaccgtttaccggttaccgggtacccgtaacgttacccgggtaaccccgttacccg

SEQ ID NO: 104694 - DNA, 894 bp, Homo sapiens
  misc_feature: GYAE6OF02JREY1.17.34.D01.1.454.CMB.1.raw
  modified_base (192)..(192): a, c, t, g, unknown or other
  misc_feature (192)..(192): n is a, c, g, or t
tcagcgtagactagcacgaccggtgctcgatttagatcgtctgtgttgggtttggggacaaacaaccagattcctcctctaaagaagcccctgggagcacagctcatcaccatggactggacctggaggttcctctttgtggtggcagcagctacaggtgtccagtcccaggtccaggttggtgctaatcgnggggtctgaggtgaagacgcgtggtcctcggtgacgggtctccgtgacgaaggtccttcgtggacggtctaccttcgagacgtacctattacgtttacaagtttcggggtgcggtaccgggtccgttacgtagggacgtaacggtccgttagggacggttaggtaggtcggggaaacgggtacgttacccggttaccccgttaagtttccgggtttaaggaaccccgtaaaccgtaaacccgtaaaaacccgttaccggacccgtaagtaaccggaaaccggttttacggaaccggggtaccggtaacggaaccccgttaacctaaacccggtaacgtaaacccccgggtaacggggaaacccttaaaaaacgtttaaccccgaaaccggttaactaaacggtttaaaccgttacgttaacgggaggtaaccttaacgaaccgtaaccgccgttactaacgtaccgtacgtaacgggaacggtacgttaacgggtccctttaacgttaccttaccgttggtacgtaacgggtacggttaaagttaaaccttttacggaaacttacgtacccgttagttaccccgttttacttttaacccgaccccttttacccggtaacgttttccggtttaccggacccggggttaacctaccgggttaccccggttaaacccgggttacccgtaccccggtttaaccccg

SEQ ID NO: 104695 - DNA, 673 bp, Homo sapiens
  misc_feature: GYAE6OF02IZEL6.17.34.D01.1.454.CMB.1.raw
  modified_base (181)..(181): a, c, t, g, unknown or other
  misc_feature (181)..(181): n is a, c, g, or t
  modified_base (498)..(498): a, c, t, g, unknown or other
  misc_feature (498)..(498): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacccgcttaaaccgggacaaccgtcgcccggccaacatacgccttctcccgtcccccttcgcagtaacaccaagtacaggaatattaacctgttcccatcgactacgcctttcgcctcgccttagggtcactcacctcgccccgtattaacgtggacaggaacccttggtcttccggcgacgcgggtcttttcacccgtctttactcgttacttatcgtcacgctatttccgctacctttctgacttacctccagcatcgccctacaccacgtcacctacccttcaacgtacggtaccttaacacggtaaccnccctacccctaaacccgaaccaaaccgcaaacgttaacgccgtaccgctaccggccccgtacacggttccgttaccggtcgtacctaacggtttcgggtttaacctcccccggttttcaaccgtttccctttcccgaccttacgttccctacggtaccttaccgtccgtaaccgg

SEQ ID NO: 104696 - DNA, 547 bp, Homo sapiens
  misc_feature: GYAE6OF02GG5I8.17.34.D01.1.454.CMB.1.raw
  modified_base (321)..(321): a, c, t, g, unknown or other
  misc_feature (321)..(321): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggcttcgtggaggcaccttcagcgactatagtttcaattgggtgcgacgggctctggacaaggccttgagtggatgggaagntcgtcctatcgttgacacacaaactcgcacagagttcaggcagactcaccataccgcgaacaaataacgaacactaagtaatacgtaggacgacgtagaacagacctgtacatctagacgacgacggtcttactactctgtgcgagtacgttaattatactacactgtcttaccttttaccaccttccttgtaccttcgtcgggctacgtaccggtacccgtaccg

SEQ ID NO: 104697 - DNA, 972 bp, Homo sapiens
  misc_feature: GYAE6OF02HMSEP.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgccgtgggtcctcgggtgacgggtcctccgtgacgaaggtccttcgtgggacggtcctaccctttcgacggccgtacttaagttacgttttccgaaagtttggggtacggtacggaccggggccttccggtagggaaccgtaacgggtcccgtttaggaacgggttacgggaaggttcggggtaaagggtaccgttcccggttacccctaagtttccgggtttacggaaccctaaaccgtaaaccccgtaaaacgttaccggaaccgtaaccggtaacggtaaaccgtttacccgggaaaggggtacccgtaaacggtaacccgttacccgaaacccgtaacgtaaaccccgggaacgggtaaaaccctaaaacgtttaaacccgaaaaccgtaacgtaaacggtttaaacgtaccggtaggtaaccgtacgttaacggaaacccgtacggtacccgttaagttacccgtaacgttaccggttaacgggtaacgggtaacccgggtaacggggttacccgttttacccgtttaacccgttcgggtttacgggtaaccgggtaccgggttaaagggtttaaacgtttaaacgtttaacgttaaacggtaacccgttaacgtttaccggtttaacccttttttaaccccgtttttaaccccgttaacccgttttaccccgtttacgggttaacccgttttaccggggtaccggggttaacccttaaccggggttaccccgggtaacccccggtttaaccccggg

SEQ ID NO: 104698 - DNA, 557 bp, Homo sapiens
  misc_feature: GYAE6OF02FV532.17.34.D01.1.454.CMB.1.raw
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttggagtggatgggaaggtatcgtcctagtcgttgacacaccaaactacgcacagaacttccgaggcagactcaccataaccgcgaacaatacgaanacataanctagagcagaacacgactgtcatcgtagaggactacgggtcttactacgttctgtcgcgaggagtagttactatactactagtccttacctttactacccttccttagtaccttcgtcgggtacctacgttacccggacccgttcccg

SEQ ID NO: 104699 - DNA, 614 bp, Homo sapiens
  misc_feature: GYAE6OF02HEUCF.17.34.D01.1.454.CMB.1.raw
  modified_base (469)..(469): a, c, t, g, unknown or other
  misc_feature (469)..(469): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctccgtgcaaggcttcgtggagcaccttcgacgcgactattagtttcaagttgggtcgcggtacgggcctcgtgggaacaacgggtccttggaggtggagtggggaaggtactccgtcctagtccgttagaccacgaccaaacgtccgacacgagtacgtcgagggcagactacacactaccggacggaactaaactaacgaacactaagttaatcgtagagtctagaacagtaccgtntacatccgtagacggaccgacggtcttacgtacttacgtgtcgacgtagtacgttaattacgtaatacctgtaccgtcttaaccctttactaccccttccttcgtaccttcggtcggtccctaacggttcccggtacccgtaccg

SEQ ID NO: 104700 - DNA, 648 bp, Homo sapiens
  misc_feature: GYAE6OF02G9HPC.17.34.D01.1.454.CMB.1.raw
  modified_base (260)..(260): a, c, t, g, unknown or other
  misc_feature (260)..(260): n is a, c, g, or t
  modified_base (381)..(381): a, c, t, g, unknown or other
  misc_feature (381)..(381): n is a, c, g, or t
  modified_base (439)..(439): a, c, t, g, unknown or other
  misc_feature (439)..(439): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctcctgcaaggcttcgtggaggctaccttnagcgactatagtttcaagttgggtgcggacggcctcgtaggacaaggtccttagaggtggagtgggaaggctcgtcctatcgtacacacaccaaactcgcaacagacgttcgaggcagacncacacgtaaccgcggaactaaactaacgaacactagttaactcgtaggagctagaacncgtacctagtactatctaggacgtacgtacgggtacttacgttacgttcgtacggtcgtacggtaaggttaacttaacgttaactaacgtaacgtcttacgttacccttttacccgttttacctaccccgtttaccgttacgtaccgtttccggtaccgggtaccttaccggtaacccgggtaccccgttacccgtacccgttaccccg

SEQ ID NO: 104701 - DNA, 566 bp, Homo sapiens
  misc_feature: GYAE6OF02GMFZR.17.34.D01.1.454.CMB.1.raw
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
  modified_base (487)..(487): a, c, t, g, unknown or other
  misc_feature (487)..(487): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagtttgggtgcgacgggcctcgtggacaaggccttgagtggagtgggaaggtntccgtcctatcgttgacacaccaaactcgcanagatcaggcagactcacataccgcgaacaataacgaacacaagttaatcgtagacgactacgaacacgcctgtctatctagagacgacggtcttactacttctgtgcgagtagttaattactatacnctctcctttcctttttaccaccctttccgtttacgtacgtttccgtacgggtcctacgttacccggaccccgttacccg

SEQ ID NO: 104702 - DNA, 654 bp, Homo sapiens
  misc_feature: GYAE6OF02G2Q3R.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggtcttcgtggaggctaccttcagcgactatagtttcaagttgggtgcggacgggcctcgtggacaaggccttgagtggatgggaaggatcgtcctagtcgttagacaccaaccaaactacgcaacagaacgttccgagggtacaggacctacaaccaacgtaaacccggacggtaaactaaaacgtttaaaccgaaaccaacgtaagttaaactaccgttaggaacgtacttaggaaaccaggtccctagtactagtctaggacggacgacggtcttacgttactttcgtgtcgcgtaggtaagttaacttactaataacgcttacgtccttttaccgtttacctaccctttcccttagtacccttttacgaccgggtcctacggttacccgggaaccccgttacgacccgttccc

SEQ ID NO: 104703 - DNA, 682 bp, Homo sapiens
  misc_feature: GYAE6OF02IUCKR.17.34.D01.1.454.CMB.1.raw
  modified_base (474)..(474): a, c, t, g, unknown or other
  misc_feature (474)..(474): n is a, c, g, or t
tcagcgtagactagcacgaccggtgctcgatttagatcgtctgtgttgggtttggggatcgacaaaacaaccagattcctcctctaaagaagcccctgggagcacagctcatcaccatggactggacctggtaggttcctctttgtggtggcagcagctacaggtgtccagtcccaggtccagttggtgcaagtcgtggggctggaggtggaacgcgcctgggtcctcggtgagggtctcctgcgaaggtcttcgtgggtaggcctaccttcgacgtcggaactacttaggtttccaagttggggtcgcggacgggcctgtgggaacaagggtccttggacgtggagtagggaagatcggtaccctagtcgttagacacactaaactacgcaacagtaagttcccgagggcacgacctacaccacgtaaccggacggaactaaagttaaaccgaaactacgaaggttttaaacnccgttagggaacgtcgtaaaccgaacgtaccgtacctagtacctacgtagacgggacgaacggcgttacgttccttagtcgtggtacgagtaagttaataacgttacaactactacggttactacccgttttaaccttcctaacccgttctttaaccggtaccttacggggtacccgtacgtaccggttacccgggaccttaacccgg

SEQ ID NO: 104704 - DNA, 830 bp, Homo sapiens
  misc_feature: GYAE6OF02GWXFN.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatctggggctgaggtgaagacgccgtgggtcctcggtgagggtctccgtgcaaggcttcgtggagcaccttcgagcgactattagtttcaagtttgggtgcggacgggcctcgtggacgaaggtcccttggaggttacggagtaggggaagtagtccgtacctagttcgtagacctacgaaccaaacgtacgcaacaagaacgttccgagggaccacgactaccaacccaacgtaaacccggacgggtaaacctaaaacgtttaaaccgaaaccgtaaaccgtaaacgtttaaacgttaccggttacgggaacgtaccgttaaacggaaaccgtaaccgttacccgttaacggtaccgtaacgttaccgtaacgggtacggtaaccggtaccggggtacctttaccgttaccgttttccgttacggttcggtaccgggttaacgggtaaacggtttaaacgtttaaccgttaaacgttaacccgttaaccgttaccggttcccgtttttaacccctttttttaacccgttacccccgttttaccccgttttacccggtttaacccgttttacccgggttaccggggttaccccgttaacccgggtttacccccggggttaaccccccgggtttaacccccgg

SEQ ID NO: 104705 - DNA, 730 bp, Homo sapiens
  misc_feature: GYAE6OF02JPNMH.17.34.D01.1.454.CMB.1.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (407)..(407): a, c, t, g, unknown or other
  misc_feature (407)..(407): n is a, c, g, or t
tcagcgtagactagcacgaccggtgctcgatttagatcgtctgtgttgggtttggggtagtcacaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgtcctgggtcctcggtgagggtctcctgcaaggcttcgtggagctacttcagcgactntagttcaattgggtgcgacggctntggacaggcctgagtgatgggaagntcgtcctagtcgttgaaccacacctaaacgcgtcaacgtaagaacggtttaccaggggtaccagtacctaccaaccaagtaaacccggnggaaacctaaaacgttaaccgaaacgtaacgtacgttaaaacgtcgttacggtaacgtcgtaagaaccgacgtaccgtacggttactaacgttccgtaacgggtacggaacggtaaccgggttacctttaccggttaacctttaccgttaggtaccggtacgggtaacgggttaaacggttaaacgtttacgtaaacttaaccgtaaccgttcgttaaccggtttaccctttttaaaccgacccctttacccgttttaccggaaccgttttaccggtaccgggtacccgttaaccggttacccgggtaaccccgttaccccgg

SEQ ID NO: 104706 - DNA, 649 bp, Homo sapiens
  misc_feature: GYAE6OF02HHAVR.17.34.D01.1.454.CMB.1.raw
  modified_base (287)..(287): a, c, t, g, unknown or other
  misc_feature (287)..(287): n is a, c, g, or t
  modified_base (344)..(344): a, c, t, g, unknown or other
  misc_feature (344)..(344): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctggtgaggtctcctgcaaggtcttcgtaggaggccaccttcagcgtactattagttcaagttgggngtcggacgggcctcgtggacaaggccttgagtggagtgggaagctcgtcctatcgtnacacaccaaactcgacaacgagtaacgttccgaggcaacgactacaaccaataacccgaggtaactaaaattaaacgaaacaactaagttaactacgtaggtacgactaacgaacacgtaccgttgtacacgtctagaaggtaccgacgggtactttaccgtactttcgtgtcgtacggaagtaagttaaagttaactaataactacgttacgtacccgtttacctttttaccgaccctttacccgtttacgttaccgtttaccggtacgggtaccctaacggttaccggtaaccccgttacccg

SEQ ID NO: 104707 - DNA, 638 bp, Homo sapiens
  misc_feature: GYAE6OF02GCK8Z.17.34.D01.1.454.CMB.1.raw
  modified_base (439)..(439): a, c, t, g, unknown or other
  misc_feature (439)..(439): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgccaaggcttcgtgggaggcaccttcagcgaactatagtttcaagttgggtgcggacgggcctcgtggacaaggtccttggaggtggagtgggaaggctcggtcctagtcgttagacgaccacctaaacctcgcacagtaacgtccgagggtacacgactcaaccacgtaaccgacgaactaaactaacgaacaactagttaacncgtagagctagaacgcgcctagtcatcaggacggacgacggtcttacgttacgtctgtagcggagtaacgttaacttactaacgtacacgtacgtcctttaccttttacctaccctttaccgttccgttaaccgtttccgttaccggggtaccctaaccggttacccgggtacccccggttcccgtaacccgttccccg

SEQ ID NO: 104708 - DNA, 807 bp, Homo sapiens
  misc_feature: GYAE6OF02I85R7.17.34.D01.1.454.CMB.1.raw
  modified_base (255)..(255): a, c, t, g, unknown or other
  misc_feature (255)..(255): n is a, c, g, or t
  modified_base (290)..(290): a, c, t, g, unknown or other
  misc_feature (290)..(290): n is a, c, g, or t
tcagcgtagactagcacgaccggtgctcgatttagatcgtctgtgttgggtttggggagtcacaaaacaaccagattcctcctctaaagaacgaccctgggagcacagctcatcaccatggactggacctggaggttcctctttgtggtggcagcagctacaggtgtccagtcccaggtccagttggtgcaatcgtggggctgaggtgaagacgcctgggtcctcggtgagggttctccgtgaccaaggcttcgnggaggcaccttcgagcactatagtttcaattgggngcgacgggcctcgtaggactaaggtccgttaggaggtcggaaggtggggaacggtaccttccggttccccgtaagtttccggttagaaccgtaacccgaaccgtaaaaccgttaccggcaaacgtaacgtaaacggtttcccgaaggggaccaaggtaccctaccaaacccgtaacgttaaacccggccgaaactaaacgttaaccgaaacctaacgtaagttaaacgtacgttacgggtacgtacgtaagaaaccgtacgtccgttagtaccgtaacgttcgtaaggtaaccggtaaccggtaccggggttacctttacccgttaccgtttaccgtacggttcggtacgggttaaacgggttaactttaaacgttaacgttaaacgtaaccttaacgttaacggtttcccttttaacccgttttttaaaccgtccccgtttacccgttttaccgttaccgtttcccggttaccgggttacccgtacggttaccccgggtaacccccggttaccccg

SEQ ID NO: 104709 - DNA, 740 bp, Homo sapiens
  misc_feature: GYAE6OF02JWQUY.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgacaatcgtggggctgaggtgaagacgctgggtcctggtgaggtctccgtgcaggcttcgtggaggcaccttcgagctactagttagtttcgaagttgggtcgacggaccgggtcctcgtaggacaggccttggacggtggagtagggaacgtacgtcgttcccgtagtcggttagaaccactaaccaaaacgtcgacctagacggtaacgttccgagggctaagactaccgaaccgtaaacgtacccggacggtaaactaaaacgttaacgaaacgtaaccgtaagtttaactcgtacggacgtactaaggaaccgtacgccgttaagtacgtaacgtacgtacggaacggtaccggtaaccgggttcctttaaccgttaccgttcgtacggttacgtaaccgggttaaggtaaacggtttaacttaaccggtaataacccgttagttaccggttcccttttaacccgtttttacccgtaacccctttacccgttcgttaaccgttccggtaccgggtaccgttaacggttacccgggtaccccggttacccc

SEQ ID NO: 104710 - DNA, 932 bp, Homo sapiens
  misc_feature: GYAE6OF02JU9A0.17.34.D01.1.454.CMB.1.raw
tcagcgtagactagcacgaccggtgctcgatttagatcgtctgtgttgggtttggggatcacaaacaaccagattcctcctctaaagaagcccctgggagcacagctcatcaccatggactcggaccctggtaggttcctctttgtcggtggcaggccaaggcctacgagggtcgtcctagtccccgaaggtcccgtaggtttcgggtacggaccaagttcggtacggggggacttggaaggggtagaaacggccggtcccgttcgggggttaccccttcgggggtggacgggggttcccttccgtggaccgtaacgggttccctttccgtaggggcggtacccttaacccgtttcgacggttacccgtaactttacgtttacggttttacaaaggtttcgggggtcgacccggtacccggggtcccttaggtcggaaaccggtacggggtcccttggacgggttaggaaggtacggggaaagtcccgttcggttccccgtaagtttcggtacgtaacccaacgttaaaccgaaaaccgtccgacctaacgtaagttaaccggtccgaagggaccctacgacctacctaaaccggtacgtaaaccccggacggttaaacctaaaccggttaaaccgaaacgtaaaccgtacggtttaaaccgttacccggtaggtacgtaaccggttaacggaacttaaaccggtccgttacgtaccgttaccgaagtaacgggtaaccggtaaccgggtaccgggttcccttaggttaacccttaggtccgtaacggtacggtacggttaaacgttaacgttaacctaaccggtacttaaccggttacttacccgttttaaccgtttaaccctcccgttttaaccgttccggttacggtcgggtaccgttaagtaccccgggtacccgtcgttaaccccgg

SEQ ID NO: 104711 - DNA, 595 bp, Homo sapiens
  misc_feature: GYAE6OF02HATAV.17.34.D01.1.454.CMB.1.raw
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (547)..(547): a, c, t, g, unknown or other
  misc_feature (547)..(547): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatcgtggggctggaggtgaagacgcctgggtcctggtgagggtctctgcgaaggtcttcgtggaggctaccttcgagcgtaactagttagttttcaattggggtncggacggtctcgtaggacgaacggtccttgagtggngtggggaagtactcgtaccctagtcgttagacaccaacaaactcganaacaaggtacgtccgaagggcaagactccgaacaacgtaccgagtaacaataacgacaanagttaacngtaggctacgtanaacagtcctncagtnacgacgacgacgtcttactctcgtaggtcgacggtacgagttaactataacactatcgttacttacctttacncccttccgttacgtaccttcgacggtcctaacgtccggtaaccctccg

SEQ ID NO: 104712 - DNA, 651 bp, Homo sapiens
  misc_feature: GYAE6OF02I9KF9.17.34.D01.1.454.CMB.1.raw
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
  modified_base (389)..(389): a, c, t, g, unknown or other
  misc_feature (389)..(389): n is a, c, g, or t
  modified_base (420)..(420): a, c, t, g, unknown or other
  misc_feature (420)..(420): n is a, c, g, or t
  modified_base (502)..(502): a, c, t, g, unknown or other
  misc_feature (502)..(502): n is a, c, g, or t
tcagcgtagactagcacgaccggtgctcgatttagatcgtctgtgttgggtttggggacaaacaaccagattcctcctctaaagaagcccctgggagcacagctcatcaccatggactggacctggaggttcctctttgtggtggcagcagctacagggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctgtggacaaggccttgaggtggagtggggaaggntcggtcctatcgttgacacaccaaactcncacagacgtccagggcagactcaccagtaacccgnggaacaaattaaccgaactaacaagtttaancgtagggacacgtagaaccgacgcctacggtactataccgtaggaacgaccggtcggttcttaccgttacttcgtggtacgnggtaaggtacgtttaaactacttaactacgtacgttcgttacctttccttttaacctacccttaccgttacgttaccgtttccggttaccggggtacccttaagggttaccccgggtaaccccccggtttaccgtaccgtttacccccg

SEQ ID NO: 104713 - DNA, 541 bp, Homo sapiens
  misc_feature: GYAE6OF02F1JL2.17.34.D01.1.454.CMB.1.raw
  modified_base (481)..(481): a, c, t, g, unknown or other
  misc_feature (481)..(481): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggctctggacaaggcttgagtggatgggagatcgcctatcgtgacacaccaaactacgcacagaagttccaggcagactcaccataccgcgaacaaactaacgaacacagttaactcgtaggacgctagaacagccttgtcatctgagacgacggtcttactacgttctgtgcgaaggtataagttactatacnctacgtcttacctttacacccttaccttgtaccttcgtcgggccacgtcggacccgtccg

SEQ ID NO: 104714 - DNA, 913 bp, Homo sapiens
  misc_feature: GYAE6OF02IHOWQ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccaggttggtgcaatcgtggggctggaggtgaagacgccgtgggtcctcgggtgagggtcctccgtgacgaggtccttcgtgggacggcctaccttcgacgtccgaacttacgttacgttttaccgtaaagtttgggggttagcccgggacgggtcccttcgttacggaaccgtaacgggtcccgtttagggtacggtgggaacgttagggggaaaggtacgttaccgttaccccgttagttacggttacgaaccctaaccgtaaacccgaaacgtacccggtaccaaccggtaaacggtaaaccggtttccgaaacgggggacctaaacgtacccgttaaccgaaaccctaacccggtaaaaccccggaccgggtaaaacccttaaaaaccggttaaaccggaaacccgtaaaccgttaaacggtttaaaccgtaccgtacgggtaacgtacgtaacgaaaccgtaccgtccgttacgtaccgtaacgttcgtaaggtaccggaccggtaccgggtcctttaccgttaacgttccggttgttaccggaacgggttaaggttaaacgttaaaacgtttaacccgttaaaccgttaacttacccgggttacctttaccgttttaacccccctttttaaccccgtccccttaaccccggtttttacgttacccggttttaccggggtacccgggtaccccgtttaaggttaccccccggggacccccgtttacccccgg

SEQ ID NO: 104715 - DNA, 909 bp, Homo sapiens
  misc_feature: GYAE6OF02ISKCF.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtagaacgacgcctgggtcctcgggtgacggggttcctaccgtgccgtaacgggtcctttcgtgggaggcctaccttcgacgcgactaattagtttccaagtttcgggtgccggacgggtcctcgtagggacctaaacgggtccgttaggtaaggtacgggaggttacgggggaaagggtacgttccggtaccccttaagttccgtttaggaaccaaccgtaaaccccgtaaaacgttaacccggaccaaacgtaaagggtaaaccgtttccggaaacggggtccgaaacggtaaccgtaccaacccgtaaaccggttaaaccccggacccgggtaaaaacttaaaacggttaaaaccgaaaccgtaaaaccgtaagtttaaaacgtaccgttacgggaacgtactaacggaaacccgtacggtacccgttagtaccgtaacgttccgaagggtaaccggacggtaacccggggtacttttaaccgttaccgttttacgttggtaccggaccgggttaaggggtaaacttttaaaacgttaaccgttaacgttaaaccgttacgttaaccggtttcccctttttaacccgttttaacccttaacccccggtttaccctttaaccggttaaccccgttttacgggttacccggggttaaccccgttaacggttacccccggggttaacccccccggttaaccccgg

SEQ ID NO: 104716 - DNA, 671 bp, Homo sapiens
  misc_feature: GYAE6OF02JJXK3.17.34.D01.1.454.CMB.1.raw
  modified_base (285)..(285): a, c, t, g, unknown or other
  misc_feature (285)..(285): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
  modified_base (500)..(500): a, c, t, g, unknown or other
  misc_feature (500)..(500): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccagttggtgcaatcgtggggctggaggtgaagacgcctgggtcctcggtgtagggtcctccgtgacgaaggccttcgtgggaggtcctaccttcgagccgtaactnttaacgtttcgaacgttggggtgccggacgggtcctcgtggaacgaggtccttggagtggagtgggaacggtntccgtaccctagttccgttgaccaccgaaccaaacgtcganacgagaacgttccgagggtcaacgtacacacccgactaacccggntaacgtaaacgttaacgaaaccnctaagtttaacncgtacggacgacctagtaacncgtcctagtacctatccgagaacggaccgtagggtacccttagttacccgtgttagccggacgaagggttactaaattacttaacactcgtcgttaccttttactttaccgaaccttccgttagtaccgttccggtcgggtacccttacgggtacccggtaacccttcccg

SEQ ID NO: 104717 - DNA, 651 bp, Homo sapiens
  misc_feature: GYAE6OF02GJ0BW.17.34.D01.1.454.CMB.1.raw
  modified_base (250)..(250): a, c, t, g, unknown or other
  misc_feature (250)..(250): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacgaggtgtccagtcccgaggtccagttggtgcaatcgtggggctgaggtgaagacgccgtgggtcctcggtgagggtctccgtgcaggtcttcgnggagcaccttcgagcgactatagttcaattgggtgcgacgggtctcgtggacgaggtccttgaggtggagtagggaagcgtcgtacctagtcggtagacacaaccaacgtcgacacagaacgtccgaggcaagacctacaaccgtaacgaacccgacggaactaaaacgttaaccgaacgtaactaacgttaatcgtaagggactacgtaagaactacgtaccgtagtcagtacgtaggacgacgtacggtccttcttaccgttagtcggtgaccggtaagtacgttaagtacctaagtaacgtacttcgtaccttttacccgtttaacctaccgtttccgttagttccgtttcggtacggtccctaaccgggttacccgaaccccgttcgtacccgtccg

SEQ ID NO: 104718 - DNA, 722 bp, Homo sapiens
  misc_feature: GYAE6OF02HYKO3.17.34.D01.1.454.CMB.1.raw
  modified_base (130)..(130): a, c, t, g, unknown or other
  misc_feature (130)..(130): n is a, c, g, or t
  modified_base (531)..(531): a, c, t, g, unknown or other
  misc_feature (531)..(531): n is a, c, g, or t
tcagcgtagactagcacgaccggtgctcgatttagatcgtctgtgttgggtttggggacaaaacaaccagattcctcctctaaagaagcccgtgggacgcacagctcatccaccatggactggacctggngttcctcttgtggtggcagcagtctacgaggtgtccagtcccgaggtccagttggtgcaagtcgtggggcctggaggtagaagacgccgtcgggtcctgggtgagggttctccgtgacgaacggtcttcgtagggacgtccaaccgttcgacgaccgtattaattacggtttaccaaagttggggttcggaccggtaccgggggtccttaccgtagggtaacgaacgggttccctttaggaacgggttggtaagtaggggtaacgacgttccgtacccgttagttcgttacggactaaccgaacccgtaaactacgtcaacgaggtaacgttccgagggtacacgactccaaccgtaatacccgaaggtacctaaaattaaccgaacgacgtaagttaacncgtaggacgatacgaactacgcgtatcgatcgtagtacggacgtacgtctcgttacttacgtcgtagtacgaggtacgttaagtaacgtaacgtaactacgtcgttacctttaccggtttaacaccctttaccgtgttaccgttccgtacgggtcctagttaccccggacccggttaccctccgttacccg

SEQ ID NO: 104719 - DNA, 535 bp, Homo sapiens
  misc_feature: GYAE6OF02F6IJR.17.34.D01.1.454.CMB.1.raw
  modified_base (282)..(282): a, c, t, g, unknown or other
  misc_feature (282)..(282): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctcggtgagggtctctgcaaggcttctggagcaccttcagcgactatagtttcaattgggtncgacgggctctggacaggccttgagtggatgggaagntcgtcctntcgttgacaccaccaaactacgcacagacgtccaggcagacncaccataccgcgaacaaataacgaacacattaanctaganctagaaccagcctnactatcngagacgcggtctntcttntgtcgngtagagtaatactatactctntcttacctttacctacccttccgttacgtacttcggtcggctacgtccggacccgtcccg

SEQ ID NO: 104720 - DNA, 574 bp, Homo sapiens
  misc_feature: GYAE6OF02FT8WM.17.34.D01.1.454.CMB.1.raw
  modified_base (263)..(263): a, c, t, g, unknown or other
  misc_feature (263)..(263): n is a, c, g, or t
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
  modified_base (497)..(497): a, c, t, g, unknown or other
  misc_feature (497)..(497): n is a, c, g, or t
tcagcgtagactagcacgaccggtgctcgatttagatcgtctgtgttgggtttggggatcacaaaacaaccagattcctcctctaaagaacgccccgtgggagcacagctcatcaccatggactggacctggaggttcctccttgtggtggcagcagctacaggtgtccagtcccaggtccagttggtgcaatctggggctgaggtgaagacgcctgggtcctcggtgagggtctcctgtcaaggcttctggacggcaccttnagcgacctatacgtttcaaatttgggtgcgacggggcctctggacaaggccttgagtggaatgggaaggntcggtccctatcgttgaccanaccaaatacgcacaggaagttccagggtacagactcaccataaccgcggaacaaattaacgaacactagttaatctagagctagaacacgcctgtcatctggagacacgggtctcgtacttctgtgcgaggataagttactanaactctagtctaccttttactacccttacccttcgtaacctttcgttcgggacctacgtaccggtaccccgtacccg

SEQ ID NO: 104721 - DNA, 646 bp, Homo sapiens
  misc_feature: GYAE6OF02GTMMN.17.34.D01.1.454.CMB.1.raw
  modified_base (332)..(332): a, c, t, g, unknown or other
  misc_feature (332)..(332): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtgggaggcaccttcagcgtactatagtttcaagttgggtgcgacgggcctcgtggaacaaggtccttggagtggagtgggaaggntcgtcctagtcgtagacaccacaaactcgacacagacgttccgaggcagacctacaaccaacgtaacccggacgggaactaaaacgtaaccgaaaccaacgtaagttaaactcgtagacgactagaaaccacggaccgttagtactaacttcgacggaacggaccggacgggtaccttacgttacttctcggtggacgtaggtacgttaattacgtaatacacttacgttacctttaccttttacctaccctttcccgttacgtaccgtttccggtaccgggtacctacggttacccggaaccccggttacccg

SEQ ID NO: 104722 - DNA, 766 bp, Homo sapiens
  misc_feature: GYAE6OF02ICACF.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagtttcctctttgtggtggcagcagctacaggtgtccagtcccaggtccaggttggtgcaagttcgtggggctggaggtgaagacgccgtgggtcctggtgagggtctccgtgacaaggtccttcgtggaggcctacctttcgaggccgtacttagttagtttacaagttgggtgcggacggtcctcgtggacaaggtcctttaggacgtggagtgggaagtatccgtacctagtcgttagaccacgaaccaaacgtacgaccgacaacgtaacggtttaccgaagggtacaacggtacctaaccgaacccgaaccgtttaacccggacgggtaaacctaaaaacgtttaaacccgaaactaaaccgtaaagttttaaacgtacgtacgggtaacgtacgttaacgaaacgtaccgtacccttaggtacctagttacccgtagggaacggtaacccgtacgggttaccgtttacgtttacttccgttgtacggtacgtaaggtaacgttaagtttaactaacgtaacctcgttacgttaccttttaccttttaccctacccgttttacccttacgttaccgtttccgggttaccggttacccttacgggttaccccggttaccccgttaaccccgg

SEQ ID NO: 104723 - DNA, 664 bp, Homo sapiens
  misc_feature: GYAE6OF02FQEXK.17.34.D01.1.454.CMB.1.raw
  modified_base (247)..(247): a, c, t, g, unknown or other
  misc_feature (247)..(247): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcnggaggcaccttcagcgactattagttttcaagtttgggtgcggacggcctcgtggacaggtccttgacggtgggataggggaaggtactccgtcctagtacgttggacctacaaccgaaactcgacaacaggtaacgttccagggacaggactaccaaccgtagtaaacccggcgaacctaaataaaccggaaactaacgtaagttaacgtacgttaggacgtacgtacgaacacgccgtacacgtactcgaacgacgacgggtcgttactacttccgtagtcgacgtaggtaagttaacgttaactacgtaaactacgtacggtaccttacctttttaccaccctttcccgttacgttaccgtttacggtaccgggtaccgtacggtacccgggttaaccccggtcctaaccccgg

SEQ ID NO: 104724 - DNA, 863 bp, Homo sapiens
  misc_feature: GYAE6OF02FYWF4.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaagacgcctgggtcctcggtgagggtctccgtgcaaggcttacgtggaggcctaccgttcaggcgaaccttatagtttcaagttgggtgcggaccgggcctcgtaggacaagggtcccgtttaggaggttggagttggggaaaggtacgttccggtcccttaagttccggtttacgaaccgtaacccaacccgtaaaacgtacccgaccgaaacgtaacggtaaacgtttacccgaacgggggcctaaggtaacccttaccgaaaccccaaaccggttaaaccccggaccgggtaaacctaaaaacgttttaaaccggaaaaccctaaaccgtaacgtttaaaacgttcccggttaagggaacggtacccgtaagggtaaacccgaacggtacccgttagtaccgttaacgttaccgtacgggtaacggaccggtaacccggggtcctttaaccggttaccgttttaccgttacggttaccggtacggtaaacgggtaacgtttaaacgtttaaaccgttaacctaccgttaaccgttacggttaccctttttaccctttttaaacccgtacccccgtttaccccttttacggtacccgtttaccggttaccggggtaccccttaagggttccccgggtaaccccccggtttaccccg

SEQ ID NO: 104725 - DNA, 622 bp, Homo sapiens
  misc_feature: GYAE6OF02FIHD8.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaacgacgcctgggtcctcggtgagggtctcctgcaaggcttctggaggcaccgttcaggcgactatacgtttcaagttgggtgcggtacgggcctctggacctaaggcctttgagtggatgggaagactcgtcctagtcgttgacacacctaaactacgcacgagtacgttccgagggtccaagacctcaaccgagtaacccgcggaactaaacgttaacgaacaacacgtaatctggagctagaacacgcctagtctaatctacggacggtacgacgggtcctttacgtaccttcgtcgtacgtacggaacggtacgtaaacttacttataactactacgtcttaccttttaccacccttccttacgtacgttccgtcgggtccctaacgttccggaccccggttacgacccgttacccg

SEQ ID NO: 104726 - DNA, 532 bp, Homo sapiens
  misc_feature: GYAE6OF02IQUN3.17.34.D01.1.454.CMB.1.raw
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (404)..(405): a, c, t, g, unknown or other
  misc_feature (404)..(405): n is a, c, g, or t
  modified_base (439)..(439): a, c, t, g, unknown or other
  misc_feature (439)..(439): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcacttcgagtcgactatagtttcaattgggtncgacgggctntggacagctgagtgatgggaagntcgtcctagtcgtganacacaactcgnacagaactcaggcagctcgacanacgngaanaactacgaanatagtaatcgngacncanaacnnccgtgactatcacgagacgacggtcttactactntcgagaggagtataagttacaataancgtancgtttaccttttcaccttccttacacttcggtacgcctagtccggtacccgtcgtacctccg

SEQ ID NO: 104727 - DNA, 609 bp, Homo sapiens
  misc_feature: GYAE6OF02INPP4.17.34.D01.1.454.CMB.1.raw
  modified_base (331)..(331): a, c, t, g, unknown or other
  misc_feature (331)..(331): n is a, c, g, or t
  modified_base (459)..(459): a, c, t, g, unknown or other
  misc_feature (459)..(459): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgagggtctccgtgcgaaggtcttcgtggaggccaccttcgagcgactatagtttcaaagttgggtgcgacgggcctctggacaaggccttgagtggagtgggaaggntcgtcctagtcgttgacacaccaaacgtacgcaacagaacgttccgaggcacgactcaccataaccgacggaacaaattaacgaacaacaagttaactacgtagacgacgtagaacagcctgtacatntagacggaaccgacggtaccttacgttacttacgtgtcgtacgaggtagtaaacttacgttaataccgtactgtacccttaccttttaccgtacccttcccgttacgtaccttcggtcgggtaccctacgtaccggtaccccggtacccg

SEQ ID NO: 104728 - DNA, 570 bp, Homo sapiens
  misc_feature: GYAE6OF02F0KVG.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagtttcaattgggtgcgacgggcctcgtggacaaggccttgagtggatgggaagatcgtcctatcgtgacacacaaactacgcacgagacgtcgaggcagactcacactaccgcgacaaatacgaacacagtaatctaggagtcgtagaacacgtcctgtcactctagacggacgacgggtcttacgtacttcgtgtgacgtaaggtaagtaattactaatactactacgtacttccttttacctacccttcctttcgtactttcggtccgggtacctacgtaccggtaccccggtacccg

SEQ ID NO: 104729 - DNA, 963 bp, Homo sapiens
  misc_feature: GYAE6OF02HCE1K.17.34.D01.1.454.CMB.1.raw
  modified_base (252)..(252): a, c, t, g, unknown or other
  misc_feature (252)..(252): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggagttcctctttgtggtggcagcagctacaggtgtccagtcccaggtccagttggtgacaatcgtggggctgaggtgaagacgcgtgggtccgtcggtggagggtcctccgtgacaaggtcttcgnggcgctaccttgacgcgaactagttagtttctaagttgggtgccggtacgggtccttcggtaggaacgtaacggtccgtttaggacggttggtaacggttaggggaacgggttacgtttacccggttaccctttaaggtttccgggtttaacgaaaccgtaaccgtaaaaccccgtaaaaaccgttaccggaacctaaaccggtaaacggtaaccgggtttacccgggaaaggggacccgtaaacggtaacccttaaccggaaaacccgtaaaccggttaaaacccccgggtaccggtaaaaacccggttaaaaaaccgttttaaaacccggaaaacccgttaaaccgtaaaacggttttaaccgttaaccggttaacggtaaccggttaaacgtaagggaaaacccgtacgggtaccccttaaggttaccgtaaacgttaccggttacgggaaaccggtaacccgggtaccgggttacccttttaacgtaccgttttcgggtacggttcgtaaaccgggtaaggtttaaacgtttaaaccgttaaaccgttaaacgttaacccgttacggttaccgtttaaccctttttaccccggtttttaacccacccccgttttccggtttaaccggtttaccgtttccgggtttaccgggtaacccgttaccggttacccccgggtaaccccgtttacctaccccgggtttacccc

SEQ ID NO: 104730 - DNA, 652 bp, Homo sapiens
  misc_feature: GYAE6OF02JCT0O.17.34.D01.1.454.CMB.1.raw
  modified_base (187)..(187): a, c, t, g, unknown or other
  misc_feature (187)..(187): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtncaatctggggctgaggtgaagacgcctggtcctcggtgagggtctccgtgcaaggcttcgtggaggcaccttcagcgactatagtttcaagttgggtgcgtagtcggggcctgtggacaaggtccttggaggtggaagtaggggaacgtgtccgtcccgtagtcgttacgacacaaccaaactcgacacgtagtaacgtcgaggcaagactaccaacacgtaaccgacggaactaaacgttaaaccgaacactaagttaactcgtaggacgctagaactcgtaccttgactactcgtaggacggaccgtacgggtacttacgttacgttcgtacgtcgtacggacggttagttaacttagtactaacctaccgttcgttacccttttacccttttaacctacccctttacccgttacgttaccgtttcggtaccgggtacccttacggtaccccggtaaccccgg

SEQ ID NO: 104731 - DNA, 817 bp, Homo sapiens
  misc_feature: GYAE6OF02HRFA7.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgacaatcgtggggctgaggtgaagacgccgtgggtcctggtgacgggtctcgtgcaaggtcttcgtgggacgctaccttcgagaccgtacttaacgttacgtttactaaggtttggggtcgacgggtaccgggtcccttacggtacgggaaccgtaacgggtccgtttaggagggttacgggtaaggttaggggaaacggtcgttacccggttacccgttaagttccggttacgaaccgtaacccgaaacccgtaaaccgttaccgacctaaacgtaaggtaaccgttccggaagggtacaacggtaccctaccgaaaccgtaacgtaaaccccggtacggaaacctaaaacgttaaccgaaacctaacgttaaacgttaactcgtaggtaactacgtaacgaaacgtcggtacccttagtacctagttaccgaagggaaccggttaacccggtacggttaccctttaccgtttaccgttacgttcggtaccggtacggtaaagggttaacttaaactttaacgtaacttacgtaccgtttcgttacccttttaccctttaacctaccctttcccgtagtttacccgtcggttaccggtacccttacggttaccccggtaccccgtaccg

SEQ ID NO: 104732 - DNA, 582 bp, Homo sapiens
  misc_feature: GYAE6OF02F1S6O.17.34.D01.1.454.CMB.1.raw
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggacggcaccttnagcgactatagtttcaattgggngcgacgggcctctggacaaggtccttgagtggatgggaaggntcgtcctatcgttagacacaaccaactcgacacagaagttccagggcagactcacacgtaaccgcgaacaaattaacgaacactagtaactcgtagagtcgtagaacagtaccgtgtacatctagacgacgacggtcttctacttcgtgtgacgagtagttaatactaatactactacgtcctttaccttttaccacccttccgttagtccgtttaccggtacgggtacctacggttacccggaccccgttacccg

SEQ ID NO: 104733 - DNA, 661 bp, Homo sapiens
  misc_feature: GYAE6OF02HBC19.17.34.D01.1.454.CMB.1.raw
  modified_base (284)..(284): a, c, t, g, unknown or other
  misc_feature (284)..(284): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttctggaggcaccttcagcgactatagtttacaagttggngcgacggctctggacaaggccttgagtggatgggagatcgtcctatcgtgactacacaaactacgcacaacgtaagttccgagggtacaacggtactaccgaaccaataacccggacgtaactaaaacttaacggaactaaacgtaagttaaactcgtaggagtactagaaaccgacgtaccttagcctaagttcgtacgacggaaccgtaccggtaccttaccgttaccgttcgtagtcgacgggtaacggtaattaacgttaacgtaatacctacgttacggttccctttaaccttttaccgtaaccctttcccgtttacgttacgtttacccggttagggacccctacggttacccgggtacccccgttacccg

SEQ ID NO: 104734 - DNA, 701 bp, Homo sapiens
  misc_feature: GYAE6OF02GEIA0.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggtcttcgtggaggcaccttcacgcgactatagtttcaagtttgggtgcgacgggcctcgtaggacaaggtccttggacgtggagtgggaacgtatccgtcctagtccgttagaaccacaacctaaactacgacaacaagtacgttcgaagggcaagactacaacctacgtaaccgacgaactaaacgtaacgaaacacgtaagttaactcgtaggactacctaagaaccacgtacctgtacagtcgtacgaggaccgtacgggtcctttacgtacgtttcgtacggtcgacggttaaaggtaacgtttaaacgttaccttaaacttaaccgttacgttaccgtttaaccgttttaacccctttttaaccgtaccccgttttaccgtttaccgtttaaccggtttccggttaccgggtaacccgtaacgggttaccccgggtaacccccggtttaccccg

SEQ ID NO: 104735 - DNA, 630 bp, Homo sapiens
  misc_feature: GYAE6OF02GMOUL.17.34.D01.1.454.CMB.1.raw
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcacgcgacttatagtttcaagtttgggtgcggacgggcccttcgtggaccaaggtcccttggaggtggagtggggaaggtactccgtccttagtcgttcgacgaccaaccaaacgtacgcaacagaagttccaggcagactcacacgtaaccgcgaacaaaacttaacgaacaactaagtaactactaggagactagaacacgaccgtagtcagtctacggagacgacggtcttacttacttcgtgtcgacgtaggtaacgttaagttactaactaactactgtaccttaccgttttaacctacccgttccttacgtaccgtttcggtccggtacctaccgttaccggtaacccggttccgtacccgttcccg

SEQ ID NO: 104736 - DNA, 855 bp, Homo sapiens
  misc_feature: GYAE6OF02HP1W8.17.34.D01.1.454.CMB.1.raw
  modified_base (183)..(183): a, c, t, g, unknown or other
  misc_feature (183)..(183): n is a, c, g, or t
tcagcgtagactagcacgaccggtgctcgatttagatcgtctgtgttgggtttggggtagtcacaaacaaccagattcctcctctaagaagccctgggagcacagctcatcaccatggactggacctggaggttctctttgtgtggcagcagctacaggtgtccagtcccaggtccagttggngtcaatcgtggggctgaggtgaagacggcctgggtcctcggtggacgggtctcctgcaaggtccttcgtggaggccaaccgtttcgagaccggtatacgttagtttcctaaagttggggtagcggaaccggggccttcgttagggaacctaacggccctttagggaggttcggaagttaggggaacgggtaacttccggttcccgttaaagtttccggttagtaaccgtaaccgaaccccgtaaaagtttaaccggacctaaacgaacggtaaacggttttacccgaaggggttaaaccacgggtaaacttcccgtaaacccgaaacggtttaaaaccccggacggggtaaaccctttaaaaaccgttaaaaacgggtaaacccctaaacgtaaaccgggtttaaactacggttacgggtaacgtacggtaacgtaaaccgacggtacccgtacgggtactacttaccgtaggtaacggtaacggtaccgggtaccgttaccgttacccgttacgttaccgggtaccgtacggtaacggtaaacgttaaagttaaccctaattaaaccggtaccgtacgtacctttacccgttttttaaacaccccttttacccgttacgttacccgtttacggtccgggaaccgttcctaccgggtaccccggttaacccg

SEQ ID NO: 104737 - DNA, 826 bp, Homo sapiens
  misc_feature: GYAE6OF02GTIX5.17.34.D01.1.454.CMB.1.raw
tcagcgtagactagcacgaccggtgctcgatttagatcgtctgtgttgggtttggggatcacgaaaacaaccagattcctcctctaaagaagccccgtgggagcacagctcagtcaccatggactggaccctggaggttcctctttgtggtggcagcaggctacgaggtgtccagtcccaggtccagttggtgcaatcgtggggctggaggtcgaagacgctgggtcctcggtgacggtctccgtagacaaggtcttcgtggacgcaccgttcagacgactagttacgttcgaagttcgggtgccggtaacggcctcgtaggaacgaacggtccgttggaacgtggagttacgggaaggtacgtcgtacccgtagttcgttacgaaccaccgtaaccgaaaacgtaccgacaacgtacgtaacgttccgaagggactaacgtacctaccgaacaaccgtaaacccgggaacgtaaaccgtaaaacgtaaccggaaaacctaacgtaaacgttaaactacccggtaagggtaaaccgtacgttaaccggaaacctaccgggtacccgtaacgtacgttacggtaggtaaacccgggtaccgtaaccggggtccttttaaccggttaccgtttaccgtagggttaggaccggttagggttaaaaccgtttaaacgtttaaacgtaaacctaaaccggttccttacggttacccgtttttaacccgttttaaccctacccgtttaaccccgtttacggtcccgtttaaccgggttcgggtaaccccttaaccggttacccgggttaaacccccgtcccttaaaccccgg

SEQ ID NO: 104738 - DNA, 722 bp, Homo sapiens
  misc_feature: GYAE6OF02HGIIG.17.34.D01.1.454.CMB.1.raw
  modified_base (253)..(253): a, c, t, g, unknown or other
  misc_feature (253)..(253): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtggagggtctccgtgacgaaggcttcgnggacggcctaccttcagcgactatacgtttcaagttgggtgccggacgggcctcgtggacaacggtccttggagtggagtgggaaggtactccgtccctagttcgttacgaccaacgaaccaaactacgctaacgaacgtaagttccgaagggtcacgtaacctacaaccctaagtaaacccggcgtaacgaaactttaaaccgaaactaaccgtaacgttaaagtaaccgttagggaacgtaacgtacgtaaacgacgaccgttccgttacacgttacgtacgtacggaaccgtcgggtaaccgtttccttacgtttaccgttaggtacggtacggtaaggtaacggtaaacgtttaaccgttaactaacgttaaccttagtacctttacccttttaacctacccgttacccgttacgttaccgttacggtcgggtaccgtacgttacccggacccggttaaccccgg

SEQ ID NO: 104739 - DNA, 750 bp, Homo sapiens
  misc_feature: GYAE6OF02JYPW1.17.34.D01.1.454.CMB.1.raw
  modified_base (669)..(669): a, c, t, g, unknown or other
  misc_feature (669)..(669): n is a, c, g, or t
  modified_base (687)..(687): a, c, t, g, unknown or other
  misc_feature (687)..(687): n is a, c, g, or t
tcagcgtagactagcacgaccggtgctcgatttagatcgtctgtgttgggtttggggatcacaaaacaaccagattcctcctctaaagaagccccgtgggagcacagctcatcaccatggactggaccctggacgggtttcctccttttggtggtggcaggcaaggcctacaggtgtcctagtcccacggtcctaagttggtgcaatcgtggggctgaggtgaacgacgccgtgggtcctcggtgaggggtcctcctgctaggcttcgtggaggcaccttgagcgactagttacgttcaagtttcgggtggcggtaaccggggccttcgtgggtactaacggggtcccttaggaggttaggagttagggggaaaggtcgttaccgttccccgttaacgttcgggttttaccggaacctaccctaaccccgtaaaaccgttaaccggcctaaaccggaaggtaaaccggtttacccgaggggtaactaacggaccttaacccgaaacccgtaccgtaaaaccccgggtcgggaaaaccttaaaagttaacccggaaaccaaccggttagttaaactaccgtacggagccgttaacgaacaaccggtccttacgacgtacgtacgtacgaaggacccacgggttacttcgttacccttgtcgtcgaacggntaacggattaacataacnctagtcctttcttaaccacccttactcgtacttcggacggtcccaggttcccgaacccgtccg

SEQ ID NO: 104740 - DNA, 673 bp, Homo sapiens
  misc_feature: GYAE6OF02J2CJ0.17.34.D01.1.454.CMB.1.raw
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
  modified_base (464)..(464): a, c, t, g, unknown or other
  misc_feature (464)..(464): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggtttcctctttgtggtggcagcagctacgaggtgtccagtcccaggtccaggttggtcgcaagttcgtggggctgagggtagaagccgccgtgggtccgtggtgacggtctcgtgacgacgtctttgagggaggcctaccttcgagcgtacgtatagtttcaagttggtgcgacggctgngacagtcctgngtggagtggagngtccnctntgtnactacacaactcgnacgagtacgtcgagcacactacaccaacgtaccgacaacgtaaactacgaactaactacgttaatacgngtaagacgttacgaacgtcgtaccgttacgttnaacgttcgaacggtacggtaccgtaacgggttccttaacgtacgtttccgtaggtacgacgtaaacggttaattaacgtaagtaacctaacgtcgtttacgtacccgtttttacctttaccgtaccccgtttaccgtttaccgtacggtttacccggttaccggggtaccctttaccggggttaaccccgtaccccggttttaacccgg

SEQ ID NO: 104741 - DNA, 830 bp, Homo sapiens
  misc_feature: GYAE6OF02FXMIK.17.34.D01.1.454.CMB.1.raw
  modified_base (252)..(252): a, c, t, g, unknown or other
  misc_feature (252)..(252): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacgaggtgtccagtcccaggtccagttggtgcaatcgtggggctggaggtgaagcgccgtgggtcctcggtgaggtctccgtgacgaaggcttcgnggagctacgtcagcgactatagttcaagtttgggtgacggacgggcctacgtaggaacgtaaggccttaggaggtacggaggtaggggaagtaacgttccgtaccctagttcggttagaacctaaccaaccgtaaaaccgtacgacctaacgaaggaaccgtttcgaagggtaccaacggaaccttaccaaacccggaaacgttaacccggaaccgggtaaactaaaaacgttaaaccggaaaccaacgtaaaacgttaaagttaccggtaaggaacgtacgttaacgaaacccgagtaccgtacggttactaacgttacgtacggtacggtaaaccgtaccgggttaaccttaccgtttaccgtttacggttaggttacggtaccgggtaaggtaaaccgtttaaagtttaaacccttaacgttaacgtaccgttaaccgtttacccgttttaacccgttttttaaacccgtaaccccgtttaccccgttttaaccggtaacccggttttaccgggttaaccggggttaccccgtaacgggtttaacccccgggtaaccccgggtttaaccccccgg

SEQ ID NO: 104742 - DNA, 856 bp, Homo sapiens
  misc_feature: GYAE6OF02G2WS3.17.34.D01.1.454.CMB.1.raw
  modified_base (247)..(247): a, c, t, g, unknown or other
  misc_feature (247)..(247): n is a, c, g, or t
  modified_base (372)..(372): a, c, t, g, unknown or other
  misc_feature (372)..(372): n is a, c, g, or t
tcagcgtagactagcacgaccggtgctcgatttagatcgtctgtgttggggtttgggggatcacaaaacaaccagattcctccgtctaaagaagcccctgggagcacagctcatcaccatggactggacctggaggttcctctttgtggtggcagcgagctacgaggtgtccacgtcccaggtccagttggtcgcaatcgtggggctggaggtgaagacgcctgggtcctcggtggacgggtctccngcgaaggtcttcgtggacgccaccgttcgacgtcgtaacttatacgtttacgaagtttgggtacgccggacgggtcctacggtacggaacaacgggtccttaggaggtggtagtaggggaacgtnttccgtaccgtagttcgtacggaaccgaaccgtaaccaaaccgtacgacaacgaaggtaacgttccgaagggcaacggtacctaccgtaacctaacgtaacccggaccgaaactaaaaccgtaaccgaaaccgtaacgtaaacggtttaactaccgggtaacggaacgtacgttaacgaaacgtacggtacccgttaggtaaccttaacgttaccggtaacggttaaaccggtacccggtaaccgggttacccttttaaccggttacccgtttaacggttacggtttaaccgggtaccgggttaaacgggtttacgttaaaaacgtttaaccgttaaaccgttaaaccgttaccgtttaccgggttaacccctttttaaccgtttttaaccctaaccccgtttaaccggtttaccgttacgttttacccggggtccgggttaacccgttaacgggttaccccgggtaacccccgtttaccccgg

SEQ ID NO: 104743 - DNA, 797 bp, Homo sapiens
  misc_feature: GYAE6OF02G5T63.17.34.D01.1.454.CMB.1.raw
  modified_base (305)..(305): a, c, t, g, unknown or other
  misc_feature (305)..(305): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgctaatctggggtctggaggtgaagcgcctgggcctcggtgacggtctccgtgacgtaaggccttcgtgggacgcctaaccttcgaacgccgtacttatacggtttcaagtttggggtnacggacgggtccctagtaggtaacaacgggtccttggaacgtgggtagtggggaaacggtcgttaccgtcccgtaagttggttaccggaacctaacgaaccctaaaacttccgacaaacgtaaggtaaccgttacccggagggtacaacggtaaccctacgaacccgtaacggtaaacccgcggtaaaacctaaaacgtttaaaccggaaaccaacgttaaacgttaaacgttacgtagggacgtacgtaagaaccgtacggtcctacggttaacactacgacgtaaggaccggacggtttcttaccgttacgtcgtacggtagtacggttaaggtaaagtttaaacgtttaccttaaagtaccctacggttaccgtttaccctttttaacccgttttaacccgttaccccgttttaacccgttcgttaaaccggtttccggtcccgggaaacccgtttacggtacccccgggttaaccccggttaaccccg

SEQ ID NO: 104744 - DNA, 922 bp, Homo sapiens
  misc_feature: GYAE6OF02HSIPL.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgctgggtcctcggtgagggtctccgtgcgaaggtcttgtggagcctacgttcgagcgtactagttagtttcaagttgggtcgtccggacgggtcctcgtagggacgtaacggtccgttaggaggtggaggtagggaagtacgttccggtacccgtagttcgttcgaacctaacgaaccccgtaaacgtacgaccgaaacgtagtaaacgttccggaacgggactacgaacctaccgaacccgtaacgtaaacccggaccgggtaaaacctaaaacgtttaaacccggaaacctaacgttaaacggttttaaacctacggtaccggtaaaggaccgttaaacgggttaaaccgaaccggttacccgttacgttaaccgtaacgtttacccgtaagggtaaacccggggtaacccgttaacccggggttacccttttacccggtttaaccgtttcggtttaccggggtaccgggttaaccggttaacggggtttaaaattttaacccggtttaaaccgttaacgttaaaacccggttacccgtttacggttacccctttttttaacccgtttttaaccccgttaacccccgttttccccggttttaacggtttacccccgtttttacggggtccccgggttttaacccgtaaccgggttttaacccccggggttaaacccccgggtttaccccgttaacccccggttttaacccccg

SEQ ID NO: 104745 - DNA, 695 bp, Homo sapiens
  misc_feature: GYAE6OF02I9ZPW.17.34.D01.1.454.CMB.1.raw
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccaggttggtgcaatcgtggggctggaggtgaagacgcctgggtcctgggtgagggtctcctgcaaggtcttctggaggcaccttcagcgactatagtttcaagttgggtgcggaccgggctacgtgggaaccaacggccgttagaggtggaggtagggaaggcttcggtaccctagttcgttagaaccgacaaccgaaacgtcaccaacgaagtacttaccggagggcagactacaaccaagtacccggagaacaaataaccaacaactaagtaactctaggancgtanaacacggtctaagtcaagtccgtagggacgaccgtacgggttcttaccgttcgttccggtaggtaccgtgggtaaacgggtaaactttaagttaaaccgtttaacgacttacgggttactacccgtttttaacccttttaaccctacccggtttaccctttaaggtacccgtttccgggttaggggtaaccccctgggttaaccccgggtaaccccccggttacccg

SEQ ID NO: 104746 - DNA, 635 bp, Homo sapiens
  misc_feature: GYAE6OF02GU0GH.17.34.D01.1.454.CMB.1.raw
  modified_base (245)..(245): a, c, t, g, unknown or other
  misc_feature (245)..(245): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcnggaggctaccttcagcacttatagtttcaagttgggtgcgacgggcctgtggacaacggccttggagtggacgtgggaagtctaccgtcctatcgtacgacacaaccaactacgcacgagtaacgttcgaggcacgactccacctaacgtaacgacgtaacaaacttaaccgaacaactaagttaactacgtaggacgtctaagaaccgacgtaccgtagtactaactcgtagaggaccgtacggtacttaccttacgttccgttagcgtacgagtacgttaacttacctaagtacctagtcgtacctttaccgttttactacccgttaccttcgttacgtttcgtacgggtacctacggttacccggaccccgttccgtaccgttcccg

SEQ ID NO: 104747 - DNA, 662 bp, Homo sapiens
  misc_feature: GYAE6OF02IMQTU.17.34.D01.1.454.CMB.1.raw
  modified_base (475)..(475): a, c, t, g, unknown or other
  misc_feature (475)..(475): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggtcttcgtggaggctaccttcagcgactatagtttcaagttggtgcggacggcctcgtggacaaggccttggaggtggagtgggaagtctcgtcctagtcgttagacacaaccaactacgcacagtactcgagggcacgactaccaaccaacgtaacccgcgaaactaaacgttaacgaaacgtaactaagttaaactacgtaggtactacgtaacgaacgtacgtaccgtntaccgtaatcgtagaacggaaccgtacgggtccttacgttacctcgttacggtacgtaccgggaaggttaacgttaaacttacgttaataacctacgttacgtccttttacccttttaccgtaccctttcccgtttacgtccgtttacggtcgggtaccctacggttacccgggtaccccgtacccg

SEQ ID NO: 104748 - DNA, 604 bp, Homo sapiens
  misc_feature: GYAE6OF02GCBNG.17.34.D01.1.454.CMB.1.raw
  modified_base (246)..(246): a, c, t, g, unknown or other
  misc_feature (246)..(246): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagcgtagactagcacgaccggtgctcgatttagatcgtctgtgttgggtttgggggacaaaacaaccagattcctccctctaaagaagcccctgggagcacagctcatcaccatggactggacctggaggttcctctttgtggtggcagcagctacaggtgtccagtcccaggtccagttggtgcaatctggggctgaggtgaagcgcctgggtcctcggtgagggtctcctgcaaggcttcgnggaggcaccttcagcgactatagtttcaattgggtagcggacgggcctcgtggacaaggtccttggaggtggagtggggaaggatcggtcctagtcgttgacacaaccaactcgcaacagaacgttccaggcagactcaccataccgcgaacaataacgacactagtatntganctagaacagcctagtctactcgtgagacgtacggtcttactacttcgtgtgacggtagtagttaacttacgttaacttactacgttcgtacctttaccgttttacctaccctttccgttacgttccgtttacgtccggggtaccttacggttacccgggtaccccggttacgaccccgttcccg

SEQ ID NO: 104749 - DNA, 679 bp, Homo sapiens
  misc_feature: GYAE6OF02FJ7LC.17.34.D01.1.454.CMB.1.raw
  modified_base (249)..(249): a, c, t, g, unknown or other
  misc_feature (249)..(249): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgctgggtcctcgggtgagggtctcctgcaggtcttcgnggacgctaccttcagtcgactattacgtttcaaagtttggggcgtcggacgggtcctcgtggacaagggtcccttaggacggttggatcggggaaggacgtccgtcccgtagttccgttagacctaacgaccaaaacgttccgacacgaacgtaacgttcccgagggactacgacctacaaccgaagtaacccggacggaaactaaacgttaacgaacaactaacgttaactaccgtagggaactcgtagaaacctacggccttagtactactcgtacgacggacgtacgggcttacgttcgttacgttgtcggtacgaaggtacgttaacgttacgttaactacgtactagtcctttaccgttttaccaccccgtttacctcgttaccgttcggtaccgggacctacggtaccggtaccccgtacccgg

SEQ ID NO: 104750 - DNA, 653 bp, Homo sapiens
  misc_feature: GYAE6OF02GJ3BS.17.34.D01.1.454.CMB.1.raw
  modified_base (249)..(249): a, c, t, g, unknown or other
  misc_feature (249)..(249): n is a, c, g, or t
  modified_base (416)..(416): a, c, t, g, unknown or other
  misc_feature (416)..(416): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctcggtgagggtcctcctgacaaggtcttgnggacggctaccgttcagcgtactagttagttacaagttgggtgacggacgggtcctgtaggaccaaggtccttagagtaggagtagggaagtactcgtccgttatcgtgaacacacctaaacgtcgacacgagtaagttccgaggcagacctcgaaccagtaaccgngtaaactaagtaacgaacacgtaattaacgtcgtaggacgtacgtacgaacacgtccgtacgtactagtcgtacgaacggaccgtacggtccttacgttcgttacgtcggtcgaggtacgtacgttaacttaacgtaacttacgtacgtacgttacctttacccgtttaacctcccgtttacgttacgtacctttccggtagggtaccctaacggttacccggtaacccccgttacg

SEQ ID NO: 104751 - DNA, 619 bp, Homo sapiens
  misc_feature: GYAE6OF02H334R.17.34.D01.1.454.CMB.1.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (571)..(571): a, c, t, g, unknown or other
  misc_feature (571)..(571): n is a, c, g, or t
tcagcgtagactagcacgaccggtgctcgatttagatcgtctgtgttgggtttggggacaaaacaaccagattcctcctactaaagaacgcccgtgggagcacagctcatcaccatggactggacctggaggttcctctttgtggtggcagcagctacgaggtcgtccacgtcccaggtccagttggtgacaagtcgtgggctggaggtagaagcgcgtcggctcggngaggtctcngacaggtcttgaggagtccacttcgagtacgtactagttagttctagttggtcgacggcggctcgaggacacggtcttaggagtaggagtaggagtctccgtacgtacgtcgtacacgactaaccgtaacgacctacaacgacgtaacgtcgaggtaccaacgtccaacacgaacgtaacgacgtaaacctaaagtaaccgaagtaactaagtactacgtgaacgtacgagaactacgcgtanactcgtanacggacgacgtcgtacttctactgtaccgtgacggtagttactacgttacaactactactcttccttaccttacctacccgtntacgttacgtcggtacgtccgtacgtacccggacgtccctagtacccg

SEQ ID NO: 104752 - DNA, 647 bp, Homo sapiens
  misc_feature: GYAE6OF02HN8OQ.17.34.D01.1.454.CMB.1.raw
  modified_base (247)..(247): a, c, t, g, unknown or other
  misc_feature (247)..(247): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgaggtctcctgcaaggcttcnggagcaccttcagcgactattagtttcaattgggtgcggtacggcctcgtggacaaggccttggagtgggagtgggaaggctccggtcctagtcgttcgacgaccaaccgaaactaccgacacgagtaacgttcgaagggcacgactaccacaacgtaaccgacgtaactaaactaacgaactaactaagttaactcgtagacgtacgtacgaaacgacgtcgttcgtactacgtccgtagacggtaaccgtacggtcctttacttacgtcgttgtagtcgtaagtacgttaaattaccgtattaaccgtcgtttaccgttaccttttacctttacccgtccctttaccgttccgttacggttccggccgttaactccggtaaccccggtccttacccgg

SEQ ID NO: 104753 - DNA, 969 bp, Homo sapiens
  misc_feature: GYAE6OF02H3XY9.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatcgtggggctgaggtgaagacgccgtgggtccgtcggtgtagggtcctccgtggacaagggtcctttcgtagggacggtcctaccgttcgaggtccgaactttaagttaacggttttacaaaggttttcgggggtcggaccggtaaaccggggtccttccggttaacgggtaaacctaaacggggttcccttttagggtaagggttacggggtaaagtttaggggggaaaacgggtacgttaccccggttccccgttaaaggttccggttttaacggaaacccaaaccgtaaaacccgtaaaaccgttaccggtaccctaaaacggaaacgttaaaccggtttccggaaagggggtaccctaaacgggtaacccctacccgtaaacccgttaaaccgtaaaccccgggtacgggtaaaacccttaaaaacgtttaaacccggaaaaaccgtaaacccggtttaaaaggttttaaacctacccgggttaaagggaaaccgttaccggtaaacggtaaaaccgtaacggttacccgttacgtttaacccgttaacttaccggttaacgggaaacggtaacccgtaaccggggttacttttaacccgttacggttttaccgtacggttacgggtaccgtaaaggttaacgttaaactttaaaccgttaactaaccgttacgttcccgttaacgtttaacccttttaaccgaacccttttacccgtacgttacctttaccggtaccgggttaccttacggttaccccggtaacccgttacccgg

SEQ ID NO: 104754 - DNA, 592 bp, Homo sapiens
  misc_feature: GYAE6OF02JEZ0I.17.34.D01.1.454.CMB.1.raw
  modified_base (227)..(227): a, c, t, g, unknown or other
  misc_feature (227)..(227): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgngggtctcctgcaaggcttcgtgggaggcaccttcagcgactatagtttcaattgggtgcgacgggcctcgtggacaggccttggagtggatgggaagntcgtcctatcgtgacacaccaactacgcanagaatcgaggcagactcacagtaccgacgactaaactaacgaacacagttatctagagactacgaacacgcccgtacactcgtacgaggacacggtcttactacttcgtagtcgacgtagtacgttaacttactaataacctacgttagtccctttaccttttaccctacccgttcccgtttacgttaccttcggtacgggtacctacggtacccggtaccccggttcctaccccgg

SEQ ID NO: 104755 - DNA, 737 bp, Homo sapiens
  misc_feature: GYAE6OF02HC8UM.17.34.D01.1.454.CMB.1.raw
  modified_base (247)..(247): a, c, t, g, unknown or other
  misc_feature (247)..(247): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagcgccgtgggtcctcggtgagggtctctgcaagcttcgnggaggcaccttcagccgacttatagtttcaagttgggacgcgaccgggcctcgtaggacaaggtccttggagtggagtagggaaggtgtccggtccctaagttccggttagaccaacgaacctaaactcggacaacgaagtaacgttaccgaaggacaacggacctaccaaccaacggtaaccgacggaactaaaacgtaaacgaactaacgaacgtttaacgacgttacggacgtacgttaacgaaccgacgtaccgttagtacgtaattccggtagaacggaccggtaaccgggttacctttaccgtttacgttaccgttcgtacgggtaacggtaagggttaacgttaaacgttaacgttaaccgtaaccgttaccgttaccgtttaccctttacccttttttaccctaaccctttacccgtttacgttacccgttcggttaccgggtacccgtaacccggttacccgggtaaccccgttaccccgg

SEQ ID NO: 104756 - DNA, 558 bp, Homo sapiens
  misc_feature: GYAE6OF02F6GHR.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttgagtggatgggaagatcgtccctatcgttgacacaccaaactcgcacagaagttccagggcagactcaccataacccgcgacaaataacgaacacagtaatctaggagactagaacagccttatcactctagacgacgacgggtccttacgtacttcgtgtcgacgagaagttaaattactaatacactgtcttccttttacaccttcccttgtacttcgtcgggtccacgttaccggacccgtacccg

SEQ ID NO: 104757 - DNA, 846 bp, Homo sapiens
  misc_feature: GYAE6OF02G8FS0.17.34.D01.1.454.CMB.1.raw
  modified_base (238)..(238): a, c, t, g, unknown or other
  misc_feature (238)..(238): n is a, c, g, or t
tcagcgtagactagcacgaccggtgctcgatttagatcgtctgtgttgggtttggggacaaaacaaccagattcctcctctaaagaagcccctggggagcacagctcatcaccatggactggacctggaggtcctctttgtggtggcagcagctacaggtgtccagtcccaggtccagttgtgcatctggggctgaggtgaagcgcctgggtcctcggtgaggtctctgcagcttcgnggagctctcgagcgatatacgtttcaagttgggtgcgacgggccttcgtggactaacgggtccttggaggttgggagttagggggaaacggtacttacccggttacccgttaagttccgggtttagaacccgtaaaccctaacccgtaaaaccttaaccggcctaaaccgtaacgtaaaacggttttacccggaacggggcgaaacgaaccgttaaccgaaccgtaaccgtaaacccggtacccggaaacgtaaaaacctttaaaccggaacctaaccgtaaagtttaaacctacggtacggtaacgtaacgttacgaaaaccgtacgtaccccttacggtaccgttaactaccggttaacgggaacgggtacccgttaccggggttaccgtttaccgtttaaccgtttccgtacgggttacggaccgggttaaagttaaccggtttaaaactttaaccgtaaacttaaccgtccttaacggttcccttttttaaccgttttaacccgttaaccccgttttaccgtttaccgtttaccgtttaccggttccgggtacccttaacggttaccccggggtaaacccccgtccgttaacccgttcccccgg

SEQ ID NO: 104758 - DNA, 728 bp, Homo sapiens
  misc_feature: GYAE6OF02I9HWJ.17.34.D01.1.454.CMB.1.raw
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
  modified_base (452)..(452): a, c, t, g, unknown or other
  misc_feature (452)..(452): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtccccaggtccagttggtgcaatcgtggggctggaggtgaagacgcgtgggtcctggtgagggtcnctgcaaggcttcgtggaggctaccttcgagcgactagttatttcgaatttggggtncggacgggcctactggacaagcctttggagtcggtagagggaaggactccgtcccttagttccgtacgtaaccaccgaaccctaaacgtacgaccacgaagtaacgttcgacgggcaacggtactacaacctataaccggacggaaacttaaacgtaaccgaanacgtaagttaacgtacgttggacgtcgtaagaacgacgtacccgttaggtaccaagttcctaggtaacgggtaccgtacccggggtacttttccgttaaccgttgttacggttacggtcggtaaggttaacgtttaaacgtttacttaaactactacgtttactacccgttttacccttttttaccccgaccctttaccccgtttacgttacccgttacgggttacgggttacctaacggttaccccggtaaccccggttcctacccgtttccccg

SEQ ID NO: 104759 - DNA, 607 bp, Homo sapiens
  misc_feature: GYAE6OF02F976G.17.34.D01.1.454.CMB.1.raw
  modified_base (467)..(467): a, c, t, g, unknown or other
  misc_feature (467)..(467): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggattcacgtttacctcctatagtatacaacgttgggtgcgccgaggccgcgtggaccaacgacctgagtggatggggactcgggaccgaaccctaacgacgttgggtagtcacagttcgtacttccaccctatccgtaccgggacagtaccttaccagtcgaacccacgaacctcctaccaataacacacggtacctacgagttggagttagaggtacnccgtagaccatcgtagaaccgtcgacggcctcgtaacttcgtgtcgacggaagtaccgcccgacgacgtccggtagacggtccgtacggacacggtcggttccttcggtaacgttccggtacggggccctaggggtcccg

SEQ ID NO: 104760 - DNA, 895 bp, Homo sapiens
  misc_feature: GYAE6OF02HOAWN.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgctaatcgtggggctggaggtagaagaccgtccgtgggtccgtcgggtggagggtcctaccgtgacgaaggtccttacgtgggacggtccaccgttcacggaccgtacttaagttacgtttacctaaggtttcggggtgccggaccggggtcccttaggtacgggaaccgtaacgggtccttagggacggttagggacggttagggaacgggctttaccccgggttacccttaacggtcggtttaacggaaccccaaaccgaaaccccggttaaaacgtaccgtaacgaacgtaaacggttaaaccgttacccgggaacgggacaacgtacctaaccgtaaacccaaacggtaaacccgggaaccgtaaaccttaaaaacggtttaaaccggaaacccgtaaacgttaaacggttttaaacgtaccgtaaagggtacggaaacgttaaccgggaaaccgtaccggtaccgttaaccggttacctacgttaaccgtacggggaaaccggaccgtaaccgggttcctttaacccgtttacgttccgtagggttacggaacggtaacggtaaacggtttaaacctaacgttaaacgttacctaacgtttcccggtaacctttttaacccttaccttaacccccgtttactttccggtaaccgtttcggtaccggggtaaccctaccggttacccgggtaaccccgttccccg

SEQ ID NO: 104761 - DNA, 817 bp, Homo sapiens
  misc_feature: GYAE6OF02HVJCM.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctggtgagggtcctcctgcaaggcttcgtgggaggctaccttcagcgtactatagttctaagttgggtgcggacgggtcctcgtggaacaaggtccttggagtgggagtaggggaaggtactccgtacccttagttccgttagacctaacaacctaaacctaccgacaacgaaggtaaccgttccgaacgggcaacggtaacctcgaacctaacgtaaacccggacgtaaaccaaaagttaaacccgaaacctaaccgttaaaggtttaaagtcgtagggtaataccgtaagtaaaccgtacgcccgttagtaccgaacgttcgtaagggaaccggtaccgggtaacggggttaccctttaccgtttaccgtttcggtaacggtacgggtaaccgggttaacgggtaaacgtttaaagtttaaccgtaaaacgttaccgttaaccgttaccggtttaaccccttttttaacccccgttttttaaccccgaaccccgttttacccccgttttaacggttaccccgttttacggggtacccggggttaccccgtttaacccgggttaccccggggtttaacccccccgttaacccggg

SEQ ID NO: 104762 - DNA, 724 bp, Homo sapiens
  misc_feature: GYAE6OF02HXOR9.17.34.D01.1.454.CMB.1.raw
  modified_base (186)..(186): a, c, t, g, unknown or other
  misc_feature (186)..(186): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggngcaatcgtggggctgaggtgaagacgcctgggtcctggtgagggtctcgtgcgaaggcttcgtggagcctacttcagcgactatagttcaagttgggtgcgacggtcctgtacggacaaggtccttggagtggagtgggaagactccgtacctagttcgtagaccaaccaacgtaaactacgacaacgaagtaagttaccgaaggacaacgtactacaactaacgtaaaccgcgaaactaaaacgttaaacgaaactacgtaaagttaactcgtaggactcgtaagaaacacggtaccttacggtacaagttacgtaacggaggtaaccgtacgggttaccctttaactaccgttcgtaggtaccgaaccgtaagggtaaacttaaaaccgtttaactaaagtaacccgttcgttaccggttcccttttttaaacccttttaaccgtaccccgtttttaaccccgtacgggtttaaccctttacggggtacccggggtacccttaacggttaccccggggtaaacccccggtttcccg

SEQ ID NO: 104763 - DNA, 698 bp, Homo sapiens
  misc_feature: GYAE6OF02IQLCI.17.34.D01.1.454.CMB.1.raw
  modified_base (268)..(268): a, c, t, g, unknown or other
  misc_feature (268)..(268): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatcgtgggctggaggtgaagacgccgtgggtcctcgggtgacgggtctcctggcgaaggccttcgtgggagcaccttnagcgactatagtttcaagttgggtgcgacgggctctggacaaggccttgagtggagtagggaagagtcgtccctattcgttagacaacacctaaacgtacgctaacagtaacgttccgaaggcaaggactacaacctaagtaacccgacgaactaaaacttaaacgaaacacgtaacgttaactcgacggtaagactacgaaacacgtaccttgtacgtactacgtaacgaagggaaccgtacgggttaccttaacctttaaccgtttcgtacggttagtaccggtaaacgggtaaagttaaacgttaacttaacgtaaacgtacgttcgttaaccgtttaccctttttaacccgaacctttaccccgtttacgtacttacggttaccgggtacccgtaacggttacccgggtaaccccggttaccccgg

SEQ ID NO: 104764 - DNA, 712 bp, Homo sapiens
  misc_feature: GYAE6OF02H8ROG.17.34.D01.1.454.CMB.1.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (534)..(534): a, c, t, g, unknown or other
  misc_feature (534)..(534): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctgggagttcctctttgtggtggcagccagctacaggtgtccagtcccaggtccagttggtgcatcgtggggctgaggtgaagaccgcgtgggtcctggtggaggtctccgngacacggtcttcgtaggngtacctaccgttcgaggtccgaattacgttagtttacgtaagttcggggtgccgggtaccgggccttcggtacggaacgtaacggtccgttaggaagggttggacggtaggggaacgtacgtacccggttacctaacggttcgtttacgaactaaccgtaaacccgtaaaacgtaccggacccaaacggtacgtaacggttccgaaggtaccaacgtccgaactaacccgaacgtaacccggacgtaaactaaacgtaacacgtaactaaggttaacngagtagacttgaactacgtctagtacagttccgtagacgaccggtacgtcctttacgtacttcgtggtacgagtaaggtaataaacgttcgtaagacctagtttccgaaccttttacctttaccgaccctttacccgtagtacgttccggcggtaccctacggtacccgacccgttcg

SEQ ID NO: 104765 - DNA, 659 bp, Homo sapiens
  misc_feature: GYAE6OF02FW07W.17.34.D01.1.454.CMB.1.raw
tcagcgtagactagcacgaccggtgctcgatttagatcgtctgtgtttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctgggctggaggtgaagacgcctgggtcctcggtgagggtctcctgcaaggcttcgtggaggcaccttcacgcgactatagtttcaagttgggtgcgacgggcctcgtggacaggccttaggagtggagtagggaaggacgtccgtccctagtcgttacgacacaaccaactacgacacgagaacgttccgaagggcagacctcgaacctaacgtaaccgaccggaaactaaaacgttaaccgaacaactaaggttaactacgtacggatacgtagaaacgtacgacgtacgtctatcgtagacgacgacggtcttcgttaccttcgttgtcggtcggtaggtagttaaacgttacttaagtaaccttacgtacgtaccgtttacctttttaaccacccttttaccgttaccgttacctttcggtacggtccgtaccgttaccgggaccccgttaccgtcccgttacccg

SEQ ID NO: 104766 - DNA, 875 bp, Homo sapiens
  misc_feature: GYAE6OF02HMUY3.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctggaggtgaagacgcctgggtcctcgggtgacgggtctcctgacgaaggtcttcgtggacggccaccttgacgtcgtacttagttaagtttccaaagtttgggtcgccggaccgggtccttcgtggaacaacggtccgttagaggtggagtacggggaaaggtcgttaccgttacccgtagttccggttacgaaccaaccgtaaccaaaacgtaccgacaaccgaaggtaaccgttccggaacgggtctaaccgtaaaccgtaccaaccctaaaccggtaaacccggaccgggtaaaaccttaaaaacgttaaaccgtaaaccgtaaacgttaaacggtttaaactacgttaacggaacgtaccgtaacggtaaacgtaaccgttaccgttacgttacctaacgttaacgttacggaacgggtaaaccggttaaccgggttacccgtttaaccgtttacccgtttacgttacggttacggttaaccgggtaacgggttaaaccggttaaaccgtttaaaccttaaacggttaaccgttaaccggtttaccggtttaacccttttaacccgtttttaaccccttaacccgtttaccccgtttaacggttaaccggtttacccggtaccgggttaccccggttaacggttacccccgggtaaccccggttaacccccgg

SEQ ID NO: 104767 - DNA, 593 bp, Homo sapiens
  misc_feature: GYAE6OF02FNYRT.17.34.D01.1.454.CMB.1.raw
  modified_base (326)..(326): a, c, t, g, unknown or other
  misc_feature (326)..(326): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttggagtggatgggaagtntcgtcctagtcgttgacacaccaaactacgacacagtaacgtccaggcagactcgaacataacccgacgaacaaactaacgaacaacgtaagtaactcgtaggacacgtaacgaacacgtcctagtacatcgagacgacgacggtacttactacgtcgttacgtgtacgtaggtacttaattacgtaatacgtacttcggtacctttaccttttaccaccctttcctagtaccttcgtacgggacctacgttacccggacccgtccg

SEQ ID NO: 104768 - DNA, 652 bp, Homo sapiens
  misc_feature: GYAE6OF02JX54C.17.34.D01.1.454.CMB.1.raw
  modified_base (194)..(194): a, c, t, g, unknown or other
  misc_feature (194)..(194): n is a, c, g, or t
  modified_base (426)..(426): a, c, t, g, unknown or other
  misc_feature (426)..(426): n is a, c, g, or t
  modified_base (478)..(478): a, c, t, g, unknown or other
  misc_feature (478)..(478): n is a, c, g, or t
  modified_base (558)..(558): a, c, t, g, unknown or other
  misc_feature (558)..(558): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgngggctgagtgaagacgcctgggtcctcggtgagggtctcctagcaaggcttcgtgggaggccaccgtttcaggccgaatacgttagtttccaatttggggcgcggacgggcctccgtggaccaagggtcccttggaggtaggatgggggaacggacttcggtccctaagtcgttgactacgaccaaactcgcacagtaacgttccaggccagtacctcaaccataacccggnggaactaaagttaccggaactacaagtttaaccgtacggagacttagaaacncgaccttagtccatcctagggacgaacgtaggtccctttacgacgtttactcggtagaccgaaaggtattaaccgtttanaacccgttaagccttaaggtcctttacctttttacacccccgtttaccgttatccggttgaccgggtcctaacgtcccgggtaaccccgtcccg

SEQ ID NO: 104769 - DNA, 706 bp, Homo sapiens
  misc_feature: GYAE6OF02ITI4L.17.34.D01.1.454.CMB.1.raw
  modified_base (208)..(208): a, c, t, g, unknown or other
  misc_feature (208)..(208): n is a, c, g, or t
  modified_base (303)..(303): a, c, t, g, unknown or other
  misc_feature (303)..(303): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccgacgtcccgagtccagttgggtgcaagtctggggctaggnggtgaacgacgccgttgggtcctcggtggagggtcctccgtgacgaaggtcttcgtggacggcaccttcacgcgactatagtttcgaagttgggngccggacggtcctcgtggacgaacggtccttggaggtggagtaggggaaggactccgtcccgtagtcgtacgacaccaaccaactacgacacgtaacggaacgttccgaagggctaagactacaccgaacgtaaccgccgaaactaaacgtaaacgaactaacgtaagttaacctacggtagacgtacgtacgaaccgtcgtaccgttagtctacgtacgtaggacggaaccgtacgggttacctttacctacgttctacggtgtacgaaagggttacgttaaatacgtaattaacctacgttacgtacccttttacccgtttaccttacccgttaccccgtttagttacccggttacgttcccgggtaccgtaacccggttacccgggtaccccgtaccccg

SEQ ID NO: 104770 - DNA, 645 bp, Homo sapiens
  misc_feature: GYAE6OF02FJS8U.17.34.D01.1.454.CMB.1.raw
  modified_base (289)..(289): a, c, t, g, unknown or other
  misc_feature (289)..(289): n is a, c, g, or t
tcagcgtagactagcacgaccggtgctcgatttagatcgtctgtgttggggtttgggggatcacaaaacaaccagattcctcctctaaagaagcccctgggagcacagctcatcaccatggactggacctggaggttcctcttgtggtggcagcagctacaggtgtccagtcccaggtccagttggtgcaatcgtggggctgaggtgaagacgcctgggtcctcggtgagggtctcctgacaggcttcgtggacggctaccttcagcgactatacgtttcaattgggtncggaccgggtcctgacgacaaggtccttgacgtgggagtcggggaagtagtccggtccgagttccgttagacctacaacccaaacgtacgcacgaggtaacgttccgaggcagacctcaacactaccgcgaacaaactaacgaacactagttaactcgtgacgctacgaacacgccttgtacagtctaggacggaccgtacgggtccttactacgttacgtcgtacgacgtaaggagttaacttacgtaactaccgtacctacggtccctttaaccttttacccgtacccctttccttacggtaccgtttaccggtaccgggtcccgtacggtacccgggtaccccgttaccccgg

SEQ ID NO: 104771 - DNA, 618 bp, Homo sapiens
  misc_feature: GYAE6OF02G4R1Q.17.34.D01.1.454.CMB.1.raw
  modified_base (326)..(326): a, c, t, g, unknown or other
  misc_feature (326)..(326): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttgagtggagtgggaaggntcgtcctagtcgtgacacaccaaactacgcacagaacgtcgaggcagactacaccaataaccgacgaacaaataaccgaaccaacgtaagttaactcgtaggacgacgtacgaacgacgtccgttagtacatcgtagacggacgtacgggtccttacgttacttcgtggtgacggtaggtaagttaaacttactaactactaccgttagtcctttaccttttaaccaccctttacccgttacgtacctttccggtacgggtaccctacggttacccgggtaccccgtacccg

SEQ ID NO: 104772 - DNA, 836 bp, Homo sapiens
  misc_feature: GYAE6OF02G817N.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggtcttcgtggacggctaccttcagcgactattagtttcaagttggtgacgacgggcctcgtaggacaacggtccttaggacggttagggagttacgggggaacggtacgttccggtaccccgttaagttccggtttacggaacctaaccgaaccctaaaaccgttaccgaccgtaaacgtaacggtaaaccggtttacccggacggggaacctaacggtaaccttaccgaaacccgtaacgttaaacccccgggacgggtaaacctaaaaccgtttaaaccgaaaccgtaaccgtaacgtttaaacgtacgtacgggtaacgtacgttacgaaaccgtacgtcccgttagtaccgtacgttacgtaggtaaccgggaaccggtaccgggtaccgtttaccgtttaaccgtttacgttacggttaccggtacgggttaaacggttaacggtttaaaccgtttacgtaacgttaacccgtacgttaccgttaaccccttttacccgtttttaaccctacccccgtttaccgtttacgttaccgtttaccgggtaccgtacccggttaccggtaaccccggttaccccgttaacccgg

SEQ ID NO: 104773 - DNA, 836 bp, Homo sapiens
  misc_feature: GYAE6OF02IR4QC.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccagtccagttggtgcaatcgtggggctgaggtgagacgccgtggtcctcggtgaggtctccgtgcaaggtcttcgtggacggccaccttcacgcgtaactattagtttcaagtttgggtcgacggtacggggtcccttaccgtgggaacctaacgggtccctttagggacggttagggaggtagggggaaaggtacgttccggttaccccgttaagttcggtttacgaaccgtaacccgaaacccaaaccttaccgaccaacgtaaggtaaaccgtttcccgaaggggcctaacggtaaccctaccgaacccgtaaacgttaaacccggacgggtaaaacctaaaacgtttaaaccggaaccctaaacgtaacgtttaaacgtacggttaacggtacgtaccgtagaaacccgtcgtacccgttacgtaccgttagttaccgtacgggaaccgtaccgtaaccgggttacctttaccgttaccgtttacgtacggttcggtaaccggtaaggtaaacgtttaaactttaaccgttaacgttaacctacgtttaccggtcctttttaaccccgtttttaaccacccccgttttacccgttaccgttaccgtttccggtaccgggttaccctaaccggtttacccccgggacccccgttaacccgg

SEQ ID NO: 104774 - DNA, 703 bp, Homo sapiens
  misc_feature: GYAE6OF02F15JF.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgaggtctcctgcaggcttgtggagctaccttcagcgactatagtttcaagttgggtgcggaccgggcctcgtaggacgaacggtccttagaggtgggagtggggaaggactccggtccctagtcgttagacctaccgaacccaaacgtaccgacacaaggtaagttccgagggacacgactcgaaccacgtaacccgcgaaactaaaacgtaacaaccgactaacgtttaatccgtaggagtctaagaacacgtcctagtactactcgtaggacggacgtaccggtcttcttacgttcgtggtacgtacggaggttaacgtttaacttaaacttaaccgttaactaccggtttacttacccttttacccgttttttaaccctaccccgttacccgttttagttacccgttttcgggtacccgggtaccttaaccgggttacccccgggtaaccccgttccccgtacccggtttacccccg

SEQ ID NO: 104775 - DNA, 751 bp, Homo sapiens
  misc_feature: GYAE6OF02JFV0T.17.34.D01.1.454.CMB.1.raw
  modified_base (298)..(298): a, c, t, g, unknown or other
  misc_feature (298)..(298): n is a, c, g, or t
tcagcgtagactagcacgaccggtgctcgatttagatcgtctgtgttgggtttggggatcacaaaacaaccagattcctcctctaaagaagcccctgggagcacagctcatacaccatggactggacctggaggttcctctttgtggtggctagcagctactaggtgtccgacgtccaggtccagttggtgacaagtcgtgggcgtgagggtgaagacgcgtcgggtccgtcggtgagggtctcgtgcaggtctcgtggaggctaccttcgacgcgactatacgtttacgaagttggngcggaccggtctcgtacggaccgaaggtccttggaggtcgggaggtaggggaaggcgtacgtcccgtagttcgttactaccacgaccgtaaacgtcgacaacgagtaaccgttacgacggacgacgactaccgacgaacgtaccggaccggaactaaacgtaaacgaacctaacgtaagtttaacgtacgtacggagtacgtaacgaaacctacggaccttagtaccgttagtaccgtaggaaccggtacggtaccggttacctttacgtaaccgtttcgtaacggttacggtacggtaacggttaaacttaaccgttaagttaacgtaaccggtaccgttacggttaaccgttttacccgtttaaccgttaaccccgttcccgtttacccggtaccgtttacccgggttacggtacccggttaaccgggtacccggttaccccggtacccgg

SEQ ID NO: 104776 - DNA, 798 bp, Homo sapiens
  misc_feature: GYAE6OF02JP4NY.17.34.D01.1.454.CMB.1.raw
  modified_base (254)..(254): a, c, t, g, unknown or other
  misc_feature (254)..(254): n is a, c, g, or t
  modified_base (579)..(579): a, c, t, g, unknown or other
  misc_feature (579)..(579): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacgaggtgtccagtcccaggtccagttggtgcaatcgtggggctggaggtgacgacgccgtgggtccgtcggtgacgggtctcgtgaccaaggtcttcgnggagcctaccttcgagtccgacttatacgtttacaagttgggtcgtaccggacgggcccttacggtacggtaaccgaaacgggtccctttagggaggttgggtaagttacgggggaagggtaactccggttaccccgttaaggtccggtttacggaaacctaacctaacccgtaaaactaccggaccaaacgtaacgtaacgggtttacccgaggggacctaacggtaccgtaccaaccctaacgttaaacccggacggtaaaaccaaaacgtttaaaccgaacgaaccgtagttaaacgtcgtaaggacgtactaagtaaccgngtaccgtcgtacacgtactacggaacgtacggtacgtaccgtttacaccgttcggtatacggtacgtaggtaacttaacgttaacctaaacgttacgtacgttacgttaaccctttttacccttttaccggacccctttagtttacccgttaccgtttaccggtaccggttaccctaccgggtaccgtacccccgggtttacccgtccgttaacccccg

SEQ ID NO: 104777 - DNA, 634 bp, Homo sapiens
  misc_feature: GYAE6OF02FY20R.17.34.D01.1.454.CMB.1.raw
  modified_base (328)..(328): a, c, t, g, unknown or other
  misc_feature (328)..(328): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccacgtcccagggtccagttggtgcaatcgtgggctgaggtagaagacgcctgggtcctcggtgagggtctccgtgcaaggcttcgtggacggcaccttcagcgactattagttacaagttgggtgcgacgggcctcgtgacaaggcttgagtggatgggaagntcgtcctatcgtagacacaccaaactcacgacacgaacgtcgacggacacgactacgactaactaaccgacggaacaaacgttaaacgaaactaccgtaagtttaactaccgtagaacgtactacgaaactcgccgttcgactacgtcgaggtacgaacggtacggtcttcgttactcgttgtcggacgtaagtagttaacttaaccgtataacgtctacgttccttaacccgttttaccctacccttacccgttacgttaccgtttaccggtacggtaccgtacgttcccgggtaacccgttccg

SEQ ID NO: 104778 - DNA, 743 bp, Homo sapiens
  misc_feature: GYAE6OF02G4OJK.17.34.D01.1.454.CMB.1.raw
  modified_base (180)..(180): a, c, t, g, unknown or other
  misc_feature (180)..(180): n is a, c, g, or t
  modified_base (396)..(396): a, c, t, g, unknown or other
  misc_feature (396)..(396): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctaccgcttaaaccgggacaaccgtcgcccggccaacatacgccttctcccgtcccccttgcagtaacaccaagtacagaatacttaacctgttcccatcgactacgcctttcggccctcgtccgttaggggtccactccaccctcgccccgtatttaaccgttggaccacggtaaccccttggtccttccggcgaggtccgggtcttttaccncccgttctttactcgttacttatgtcagtctattcgctacttctagtacttcctcgagtctactcgtccctaccaacacgtacctaacctaccctttacaaccgtacggtaccttaacgaaccgtaaccgtaccccgttaccccctaaaccccaaacctaaccgtacctaaaccgttaaacgtaccggtaccgtccttaccggaccgtccgtaacgttccgttcgggttaccgtaccgttacggttcggttttaacccggttacccccgttttatacccgttttcccgtttaccccgtaccctaacgtttaccgtacggttaacccgttacgttacccgtaacccgg

SEQ ID NO: 104779 - DNA, 775 bp, Homo sapiens
  misc_feature: GYAE6OF02GHX5T.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctcttgtggtggcagcagctacgaggtgtccgagtcccgaggtcctaggtttcggtgcctaagtccgtgggggtcctaggtacggttagaacgaccggtcccgttcggggttcccttcggggtggtacgggttcccttaccgtcggaccgaacgggttcctttacgtacgggaacgggtccctaaccgtttcgacggtaccgtaccgttaagttacgttttaccaagtttcggggtacggtaccggtaccggggtcccttaggtaccgggaaactaacggggttcctttaggtaaggttggaacgttagggggaaacggtacttcccggttacccgttagttccggttcgaaccgtaccaaccgtaaacttaccgactaacgacgtaacgttccgaaggacacgaactccgaacgactaccggcgaactaactaacgaactactagtaactcgtagacgactacgaacctacgtccgtagtacgtactcgagtacgaccgtaacggtcttacttacgtcgtcgtacgacgtaggtacttaagtacgtactacgtacgtacgttctttacccgtttaccacccgtttccgttacgttacgttacggccgttaccgtacggttacccggaccccgttacccg

SEQ ID NO: 104780 - DNA, 687 bp, Homo sapiens
  misc_feature: GYAE6OF02FMY9A.17.34.D01.1.454.CMB.1.raw
tcagcgtagactagcacgaccggtgctcgatttagatcgtctgtgttggggtttgggggatcacaaaacaaccagattcctcctctaaaagaagccccctggggagcacgacgctcatcaccagtggactggacctggaggttcctctttgtggtggcagcagctacaggtgtccagtcccaggtccagttggtgcaatcgtggggctgacggtgaaggacgccgtgggtcctcgggtgagggtctcctggcgaaggtcttcgtgggaggacctaccgttacagcgtaactacttagtttacgaattggggtacgaccgggacgggtcccttcgtcggacgaacgggtccgttaggacggtagggagtagggggaaacggtagtccgttcccgtaagtttcggttacgacaacaacctaaactacggacacgagtaacgttcgaggcacgtactaccaccacgtaaccgcgaacaaactaacgaacactaagttaatacgtaggacgtacgtacgaactacgtctacgtctatcgagtacgacgtacggtcttacgttacttcgttggtacgtcgtaacggttaagtaacgttacgttaacttacgacgtacgtactttacctttaacctcccgtttactcggttacgttccggtcgggtacctacggttaccggaccccgtacccg

SEQ ID NO: 104781 - DNA, 829 bp, Homo sapiens
  misc_feature: GYAE6OF02JFUC4.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttccttctttgtggtggcagcagctacaggtgtccagtcccaggtccagttggtgcaatctggggctgaggtgaagacgcctgggtcctcggtgagggtctctgcgaaggcttctgggaggcaccttgagcgactagttacgttctaagttgggtgcggacgggtcctacgtggaacacggtccttgaggtaggagttacggggaagggacttccggttacccctagtaccggtttacgaaccgtaaccgtaaccctaaaaccttacggacctaacgaaaccgggtaaacgtttacccggaaggggtccctaagtaacccgttacccaaacccgtaaaccgttaaaccccgggccggggttaaaacctaaaacggtttaaaacccgaaaccgtaaaccgtaaagtttaaacgtcgttaacggggaacgtaaccgttaggaaaccgacgttacccgtgttaacctcgtaaccgttgggaacggtaacggtaaccgggttaccgtttaccttaaccggttttacgttacggtttaacgggcgggtaaacgggtaaacggtttaaacgtttaacttaacgtacctaacggttacgtaccgtttttaacccttttaaccgtaccctttaaccccgtttacgtaccgttttaccggttccggggtacctaacgggttacccggtacccccgggttaacccc

SEQ ID NO: 104782 - DNA, 686 bp, Homo sapiens
  misc_feature: GYAE6OF02HIEH8.17.34.D01.1.454.CMB.1.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (592)..(592): a, c, t, g, unknown or other
  misc_feature (592)..(592): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtccccaggtccagttggtgcaatctggggctgaggtgaagacgccgtgggtcctcggtgagggtctccgtgcaaggtcttcgnggtaggcctaccttcgagcgactattagtttcaagttggggtncggaccgggcttcgtggaccgaaggtcctttaggacggttggaagtggggaaggtctccggttccctagttccgttagacaaccaccaaacctacgcaacgagtaacgttccgagggtacacggacctaccaaccgaactacccggacggaaactaaaaccgttaacgaacctaacgtacgtttaataccgtggacgtaccgtagaaccacggtcccgttagtacctactcgtacggaacgggtccgtaccggttacttcgtaactttcggtgtcgtacggaaggtacttaaatcttaanacctagtctaccttttaccctttacacccctttcgttacgtacgttccggtcggtacctacgttcccggggaacccccttcgtacccgttcccg

SEQ ID NO: 104783 - DNA, 909 bp, Homo sapiens
  misc_feature: GYAE6OF02HQ80F.17.34.D01.1.454.CMB.1.raw
  modified_base (260)..(260): a, c, t, g, unknown or other
  misc_feature (260)..(260): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagtcagctacaggtgtccagtccaggtccagttggtgcaagtcgtggggctggaggtgaacgacgccttgggtcctaggtgacgggttctccgtgacgaacggtcttcgngggacggccaccgttcgacggccgtaacttacgttacggtttccaaaggtttcggggtacgccggtaaccggggtccttacggtacggtaaccgaagggtcccgttaggtacggttcgggtaaggttggggtaaacggtactcccggttaccccgtaagttccgttacgaaccgaaccgtaaccctaaacgtcggaccgtaaacgaacggtaacgttcccgaaggggtacctaagggtaccctacgtaacccgaacggttaaccccggaccgggtaaacctaaaaccggtttaaccgaaaaccgtaccgttaaaaggtttaaccgtaccgggttaacgggtaacgtaccggttaacgggtaaacccgtacgggttacccgttaaccggttaccgtaacgttccgggttaaacgggtaacgggtacccgggtaaaccgggtttccgtttaaccgtttaaccgtttccggtacgggttacgggtaccgggtaaggttaaaccgttaaacgtttaccgtaacgttaaccgtaccgtttacggttaaccccgttttaccgtttttaacccgtaccccgttttacccgttacggtttacccgttcgggtaccgggtacccgtaacggtttacccggggtaccccgttaacccgg

SEQ ID NO: 104784 - DNA, 758 bp, Homo sapiens
  misc_feature: GYAE6OF02I2R9P.17.34.D01.1.454.CMB.1.raw
  modified_base (431)..(431): a, c, t, g, unknown or other
  misc_feature (431)..(431): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaagacgccgtggtcctcggtgacgggtctccgtgacgaacggtcgttcgtgggacggcctaccgttcgagcgactagttagtttacgtaagttgggtcgcggtaccggtccgtcgtacggaacgtaacggtccgttgtaggtaggagtagggaggagtccgtccgtagttcgtcgacgtaccaaccaaaccgtacgacaacgagtaacttaccggggggggggacncgagtacctacaccaacgtaaccgacgaactaaactaacgaactaacgtaagttaacgtacgtaggacgtacgtacgaacgacgtaccgttacgtacgtacgttaccgtacgtacggtaaccgtaccggttaccttaccgttaacgtttcgttaggttacgtaccgggtaacggttaagttaaaccgttaacgttaaccgttaaccgtaacgttaccgttacccgttttaacccttttacccgttaaccccgtttcccgttaacgttacccgtttacccggttaccggtacccgtaaccgttacccgggttaacccccgtaccccgg

SEQ ID NO: 104785 - DNA, 697 bp, Homo sapiens
  misc_feature: GYAE6OF02FKKRZ.17.34.D01.1.454.CMB.1.raw
  modified_base (184)..(184): a, c, t, g, unknown or other
  misc_feature (184)..(184): n is a, c, g, or t
  modified_base (244)..(244): a, c, t, g, unknown or other
  misc_feature (244)..(244): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtncaatctggggctgaggtgaagacgccgtgggtcctcggtgagggtctcctgcaggcttcnggagcaccttcagcgactatagtttcaattgggtgcgacgggccctcgtaggacaaggcccttggaggttggagttcggggaaggtatcggtccctattcggttgaactaccaccaaaactccggacacaagaacgttccagggtcagacacaccaacgtaacccggacggaactaaaacttaacgaaacaacgtaacgttaaagtactgggaacgactacgaaacacgcctggtcaacgtacgtgacggtacgacgggtacttcgtaacgttctacggttagtaccggtaagggtaagttaaacgtttaacttaactaacctacgttcgtacccgtttaccgttttttaaccctaccctttaccccgtttacgttaacccgtttccggttcggggtacccgtaccggttaccgggtaaccccccgggttacccgtaccccgtttacccccgg

SEQ ID NO: 104786 - DNA, 847 bp, Homo sapiens
  misc_feature: GYAE6OF02G5AVY.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcgggtaggacgggttcctccgtggacgtaaggtcttcgtgggacggcctaccttcgagtacgtactaattagtttacaagtttggggtacgacggtacgggtcctcgtaggaacgaacggtcccgttaggcggttagggaggtaggggaaacggtaacgtcccggttaccgttaacgttccggtttacggaacctacctaaaacccgaaaacgttaaccgaccgtaaacgacggtaaaccggttaccgaacgggccgaaacggtacctaaccgaacccgtaacggttaaaccccggaacgggaaacttaaaaccgtttaaaaccgggaaaaccaaacggttaaacgttttaaaacgtaccgttaagggtaacgaccgttaaagaaacccgacggtacccgttacgtacttaaccgtgttacggaaccggtacggtacggttacctttaccgttaccgtttacgttacgtacggtacgggaacggttaagtaaaacgttaactaaactaccgtacgttaccggtaccttttaacccggttttaacctacccgtttacccgttaacggttaccgttaccggttacgggtaccgtaaccggttacccgggtaaccccggttaccccg

SEQ ID NO: 104787 - DNA, 957 bp, Homo sapiens
  misc_feature: GYAE6OF02HFIU8.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacaggtgtccagtcccaggtccagttggtgacaatcgtggggctggaggtagaagacgccgtgggtccgtggtggacgggttcctcgtgacgaacggtccttcgtagggacggcctaaccgtttcgacggtaccgtaaccgttaagtttacggttttaccgtaaggtttcgggggtacggtacccgggtaacccgggggtcccttacggtacgggtaaccgtaaccgggttacccgttttagggaacgggttacgggtaagggttacgggggtaaacggtaccgtttaccccggtttaccccgttaaggttaccgggtttaacgaaaccccgtaaacccgaaaacccgtaaaaccgttaacccggacccgtaaacgtaaccgggttaaaccggtttacccggaaacggggaccctaaacggttaacccttaacccgaaaaccccggtaaaccgttaaaccccggggaaccggtaaaaccttaaaaacgtttaaacccggaaaccttaaacggttaaacgttttaaacgtcggttaacgggacgtaacgtaacggtaaaccgcggtacccgttaacgttacgttaacgtcggtaacgaccgggtaaccgtaccgggtacctttacttaccgttacgtacgttacgggaacgtaaggttaaactttaaccgttaacgttaactaaccgttaccgttacgtttaccctttaccctttttaacccgtacccgtttacccgtttacggtacccgtttcggaccgggttacccgtaacgggttacccggtaacccccggttaccc

SEQ ID NO: 104788 - DNA, 709 bp, Homo sapiens
  misc_feature: GYAE6OF02HXOHF.17.34.D01.1.454.CMB.1.raw
  modified_base (143)..(143): a, c, t, g, unknown or other
  misc_feature (143)..(143): n is a, c, g, or t
  modified_base (186)..(186): a, c, t, g, unknown or other
  misc_feature (186)..(186): n is a, c, g, or t
  modified_base (246)..(246): a, c, t, g, unknown or other
  misc_feature (246)..(246): n is a, c, g, or t
tcagcgtagactagcacgaccggtgctcgatttagatcgtctgtgttgggtttggggaacaaaacaaccagattcctcctctaaaagaagcccctgggagcacagctcatcaccatggactggacctggaggttcctctttgnggtggcagcagctacaggtgtccagtcccaggtccaggttggngcaatcgtggggctgaggtgaagcgctgggcctcgggtgaggtctctggcaaggtctcgnggacgcacttcagcgatatagttcaagttgggtgacggacggtctcgtggacaacggtccgttggagtggagtgggaagtcgtctcccgttagtcgttgaccacaacctaaacacgacagaagtacgttaccgaaggcgacgtaactaccacgtaaacgtaaccggacggaaactaaagtaaccgaacacgtaacgtttaactcgtagtacggtactaacggacgtacgccgtgtaacgtactacggttaagggtaacggaccggtacgggttacccttaccgttaaccgtttacgtggtaacggtcgggtaacggttaaacttaaactttacgtaaagtaacctacgttacgttccttttaaccttttacctaacccgtttcgttaccgttaccgtttccgggacggttacccggtaaacgttacccccgggtacccgttacccggttaccccgttaacccg

SEQ ID NO: 104789 - DNA, 902 bp, Homo sapiens
  misc_feature: GYAE6OF02F7GNM.17.34.D01.1.454.CMB.1.raw
tcagcgtagactagcacgaccggtgctcgatttagatcgtctgtgttgggtttggggatcacaaaacaaccagattcctcctctaaaagaacgcccctgggagcacagctcatcaccatggactggacctggaggttccttctttggtggtggcagcagctacgaggttgtccacgtcccagggtcctaggttgggtgacaagtcgtggggctggaggtgaacgccgccgttcgggtccgtcgggtggtacgggtctccgtggacgaacgggtccttcgtgggacggcctaccgttcgaggcgtaactaagttacgtttactaaggtttggggcggaccggtaccggggtacccttcggtacgggaacgtaacgggtcccgttagggacggttagggaggttaggggaacgggttcctccggttaccccgttaaggttccggttacgaaccgaaacctaaaccgtaaaccgtaaccgtaactaaacggaacggttaaaccggttacccggaacggggacaacgtaacccgtaacccaaacccgtaacggtaaaccccggaaccggtaaaaccttaaaacgttaaacccgaaacgtaaccgtaaacgtttaacgtccggtaaggaactaccggtaaacgaaccgaccggttaccgttcgtaactacgttaccggaagggtaaccggtaaccggttaccgggtttactttacccggtttaccgttttaccgttggttacggttaaggggtaacgtttaaacgtttaaacgttacccgtaaacgttaacctacggttaccgttttaacctttttaccccgttttaacctccccgttttacgttaccgttaccgtttcccggttaaccggacccgtaaccgggttaccccggttaacccctcccgg

SEQ ID NO: 104790 - DNA, 674 bp, Homo sapiens
  misc_feature: GYAE6OF02J1A9Z.17.34.D01.1.454.CMB.1.raw
  modified_base (348)..(348): a, c, t, g, unknown or other
  misc_feature (348)..(348): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgagacgcgtggtcctcggtgagggtctcctgcgaaggtcttgtggaggtccacgttcagcacgtattagttccaattgggtcgcgacgggtctgtcggacaaggtccttaggagtcggaggtggaggtactcggtcctagtcggttnacgtacaccgaacctcgacagtagacgttacaggtcacgactcacgactacgacggaactaaacgtaacgactaagtacgtaaactgtacgggtacgacttacgaaacgacgacccgtagtcgtaaactcggttaacgaggtaaaccgtacgggtacctttacgtacgttacgtagggttcgacgggtaacggtaatttaaacgttaactaacttaaccgtacctcggttccttttaaccttttcccggaaccttttcccgttgtacccgtttcggtcggtaccctacggttaacccgggtaccccttacccgtacctttacccgg

SEQ ID NO: 104791 - DNA, 856 bp, Homo sapiens
  misc_feature: GYAE6OF02IYE89.17.34.D01.1.454.CMB.1.raw
  modified_base (187)..(187): a, c, t, g, unknown or other
  misc_feature (187)..(187): n is a, c, g, or t
  modified_base (760)..(760): a, c, t, g, unknown or other
  misc_feature (760)..(760): n is a, c, g, or t
tcagcgtagactagcacgaccggtgctcgatttagatcgtctgtgttgggtttggggatcacaaaacaaccagattcctcctctaaagaagcccctgggagcacagctcatcaccactggactggacctggtaacggttccttctttgtggtggacagcagactacgaggtcgtaccacgtacccgnggtcctaggttcggtcgacaatcgtcggggtctggtaaggtagaacgaccggtccgtcggggttccttcggggtcggacggggttccctccgttaccggacggtaacgggtccttccggtaggggacggtacctaccgttcgacgtacgtaacttagttacgtttacgaacggttgggtcgaccggaccggtcgtacgtcggtaacgaacggtccgttgggtaacgttgggaacgggtagggtacggtaacgttccgggttaccccttaaggttaccgtttacggaaacccgtaacccgtaaaaccgtaaacccggttaaccgaaccgtaacctaaacgggttaacccgttaccccggtagggaaacctaccggtaaccctaacccgtaaacccggtaaccgtaaaacccggtaaccggtaaaaacgtaaaccggtttaaaaccgaaacgtaaacccgttaagtttaaacgtcgtaacggtaacgtacgttaacggaaccgaacgttaccggttaatctaacggttacgtaacggaagggtaccgtaccggttccttaacttccgttaaccgnggtacgaacgtagttaagttacttaagtacacttagtccttaactttacctacttcctacgttgtacctcggtagaccgtcgtacccgtacctacg

SEQ ID NO: 104792 - DNA, 875 bp, Homo sapiens
  misc_feature: GYAE6OF02GJHCR.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaagtgcccactcccaggtgcagctggtgcagtcgtggggctggaggtgaagaagccgtggggcctcgaggtaggaggtctcctgacgaggtcttcgtggtattcctacgtttacctcctatagtatactaacgttgggtcgcgccgtacggcccgtcgtacggaaccaacccggtaccgtaggacgggttagggacggttagggacggtcggggacccgtaaacccgtaaccgtacggttcggggtacgtaccgtaacgtacggttacgttacctttcccgaacccctaccgtttccccgggtaacccgggtaacccgaacggttaaccctttaacccgtaacggtacccggtaaaccccgaaccgtaaccccttacccgtaaccctaaacttaaaaccccgaaccgtaaccgtaacccgttaactaaacggtacgggtaacggttacgggaacggttaccggtacccgtttaagaacccgttacgtaccgttaacgggaacccgtacccgggtaacccgggttaccccgttttaacgttaacgtttacggttaccggtacggtaccggtaacggtacccgttacccccggtaacggttaccggtacccggggttacggtaaccgggttacccgtaaccgggtacccggacgggttcccggttaccggtttttccggtaaccggttttcccggggacccggggtacccggtaaccgggg

SEQ ID NO: 104793 - DNA, 746 bp, Homo sapiens
  misc_feature: GYAE6OF02FX3UV.17.34.D01.1.454.CMB.1.raw
  modified_base (266)..(266): a, c, t, g, unknown or other
  misc_feature (266)..(266): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacagtgtccagtcccaggtccagttggtgctaatcgtggggctgaggtgaagacgccgtgggtcctcggtgacggggtcctcctgcaaggcttcgtggacggctaccttnagcgactagtgtttcaagttgggcgcggacgggtccttcgtggaacgtaacggcctttgacggtggacgtaggggaacggtacttccggtaccctagtttccggttgacctaacctaaccgaaaccttcgacgtaaccaaggtaacgttcccgaaggaccgtacgtaaccgtccaaccgtaacccgtaaacccggaccgtaaaccgtaaaccgtttaaaccgaaacccgtaacgaaccgtttaacgtaccgttacgggaacgtacgtacggaaacgtaccgcgttacgtacgtacgttaccgtacgacggtaaccgtaccggttaccttaccgttacttttcggttacgtcggtacggtaacggtaagttaactttaacttaacgtacgtacgttaccgttactttaccctttaccgtaccctttaccgttaccgttacgttccggtaccgggtacctacggtaccgtaccccgttaccg

SEQ ID NO: 104794 - DNA, 715 bp, Homo sapiens
  misc_feature: GYAE6OF02GM4YO.17.34.D01.1.454.CMB.1.raw
  modified_base (164)..(164): a, c, t, g, unknown or other
  misc_feature (164)..(164): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtntccagtcccaggtccagttggtgcaatcgtggggctggaggtgaacgacgcctgggtcctcgggtgacgggttctccgtgccaagggtcttcgngggaggccaccttnacgcgactatagtttcaagttggtgcgacgggcctcgtaggactacggccgttggacgtggagtgggaaggacgttcgtaccctatcgttcgactaccaaccgtaaacctacgaccacaaggtacgttacgacggtcgtacgacctaccaccacgaacccggttttacggaaccgtaaacgttaaaccgaaaccgtaactaacgtttaaacgtacgtaggacgttacgtaacgtaacgaccgtaccgttacgtactacgtactcggaacggtacggtaccgggtaccttaccgttaccgtttcgtcggtacgtacggaggtaacgttaacgtaaccgttataccgtacgtacgtcctttacctttttaacccgtaccctttacccgttacgtaccgttccgggttacgggtacccgttacggtcccggttaccccgtacccgg

SEQ ID NO: 104795 - DNA, 669 bp, Homo sapiens
  misc_feature: GYAE6OF02HXEJO.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggccaccttcagcgactatagttctaagttgggtgcgacgggcctgtaggacaaggccttgaggtggagtgggaagctcgtcctagtcgtagacacaccaaactacgcacagtacgtccgaggcagactacacacgtaaccgacgaacaaacgttaaacgaactaactaagttaaactacgtaggaacgtactacgaacacgtccttacgtctacgtacgtagacggtaccgtacgggtaccttacgttacttcgtacgtacgtacggtaaggtaacgttaactttaacgttaacgtaaaccgtacgttaccgttaccgttttacccctttttaacctaccccgttttacccgttacgttacccgtttcggtaccgggttacccgtaacggttacccgggtaacccccggttaaccccg

SEQ ID NO: 104796 - DNA, 690 bp, Homo sapiens
  misc_feature: GYAE6OF02HUUMA.17.34.D01.1.454.CMB.1.raw
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctggtcctcggtgagggtctctgcaaggcttctggaggcacttnagcgatatagttcaattggtgcgacgggcctcgtggacaaggccttgaggtggagtgggaagngtcgtcccgtaatcggttacacacaccaaactcgcaacgagaacgttccaagggcaactctaccaacgtaacgaccgaacgtaaactaaacgtaaaccacgtaacgtaactaactcggtaggactaacgaactaacgtaccgtcgttacgtatacgttacgagggaaccgtaccggtacggttacctttacgttacgtttcgtacgtacgggtaccggaaaggttaaaccttaacgttaacctaacgtaccgttaacgttaccgttaacccttttttaccgttaacccttaccccgtttttacccgtttaaccgttccgggttaacgtaccgttaacccgggttaaccccggttacccgtaccgttaccccg

SEQ ID NO: 104797 - DNA, 1011 bp, Homo sapiens
  misc_feature: GYAE6OF02IRDHA.17.34.D01.1.454.CMB.1.raw
tcagcgtagactagcacgaccggtgctcgatttagatcgtctgtgttgggtttggggatcacaaaacaaccagattcctcctctaaagaagccctgggagcacagctcatcaccatggactggacctggaggttcctctttgtggtggcagcagctacgaggtgtccacgtcccaggtccaggttggtgaccatcgtggggtctggaggtagaagacgtccgtgggtcctcgggtacggacgggttcctccgtcggacgaacggtcttcggtgggaacggtcctacctttacggacgtccggtaacgttaacgtttacggtttaacctaacgggtttggggttcgggtaccgggtaccgggggtacccttccggttaccgggaaccggtaacgggtcccgttttacggggtacggttaggggtaacggtgggggtaaaacggttaccggttacccgggtttaaccccgttagtttaccgggttaacggtaacccaaaccgttaaaaccccgttaaaacccttaaccggtaaccggaaacccgtaagggtaaaccgtttaccgggacgggtaccgtacgtaaacccgtacctaaaccccgaaacggttaacccggaaccgggttaaaccgttaaaactaaaccggtaaaccgaaacttaacgtaagttaccgtacgaaacgtccgttaaacgaaccggagttacccgtacgttaacgtaaccgttcgtaaaccgggttagggaaaccccggttaccgggttaaaccgtttaccccgttacgttttaaccggttacggtaacggggttaaccggttaacggtttaaacggttaaacctttaaacgtttaacccgttaaccgttaaccgttttcccggttaacccgtttttaacccctttttaccccggtaacccccttttaccggttaacccggtttaccgtttccccgggggttaaacccgggtacccgttttaaccccgggaacccggggtttaccccccggttaacccgg

SEQ ID NO: 104798 - DNA, 850 bp, Homo sapiens
  misc_feature: GYAE6OF02HQ4QE.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacgaggtgtccagtcccaggtcctagttggtgacaatcgtggggctggaggtgaagaccgccgtggtcctcggtgacgggtctctgcgaaggtcttcgtggacgcctaccgttcgagccgtaacttacgttacgttttacgaagttggggtacgacggacccgggtcctacgtacgggtaacgtaacggtccttaggacggtgggtaaggtagggggtaaagtcgtccggtaccccttagtttccggttacggaaccaacccgtaaaccctaaaacgtaccgtacgaacctaacggtaacgtttccgaacggggcaacgtaaccctacccgtaaacccgtaaacgtaacccggaaacggtaaaccttaaaaacgttaaaccgaaacccgtaacgttaaaacggtttaactaccgggtaaggtaaacgtaccggtaaacgaaaccgaacggttaccgttacggtaacctacgttaccggtaagtaccgggaaccggtaaccggtaccttttaccgttaccgttcgttaggtacgtacgggtaaacgttaacgttaaactttaaacgaaacttaacgtacctttaccgttccgttttaacccttttaaccgtacccccttttcgttaaccgttaccgttccggtacgggttaccgtaccgtacccggggttaaccccccgtacgtcccgttaccccg

SEQ ID NO: 104799 - DNA, 783 bp, Homo sapiens
  misc_feature: GYAE6OF02I5DHB.17.34.D01.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggngaagacgcctgggtcctacggtgagggtctccttagcaaggtcttcgtggacggccaccttcagcgtactagtacgttcaagttgggngtcggacggtccctgtcggagaacggtccttaggacgtggacgtaggggaagtagtccgtacccgtagttcgttacgaacacctaacaaaccgttacgcaaccgtagaagttaccgaggtaccgaagtccgttaccgacccacgttaacccggaccggtaaactaaaacgtttaaccgaactaaccgtaaacgtttaaaccgtaccgttaaggaaccgtacgtttaacggaacttaccggaaccgttcgtacgttaactcgtacggtaacgggaccgttaccgggccttttaccgtaacgttccgttaggttacggtaccgtaagggttaacgtttaaacgttaacgttaaaccgtaacttacccggtacgttacccttttacccggtttaccctaaccccttttaccccggtttgttaacccgggttttccgtacgggacccgtttaaccggtaacccggttacccccggtaccgttaccccgtttaccccgg

SEQ ID NO: 104800 - DNA, 766 bp, Homo sapiens
  misc_feature: GYAE6OF02G6U7K.17.34.D01.1.454.CMB.1.raw
  modified_base (181)..(181): a, c, t, g, unknown or other
  misc_feature (181)..(181): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngccctacccgacttaaaccgggacaaccgtccgcccggccaacatacgccttcctcccgtcccccttcgcagtaaccaccaagtacaggaatacttaacctgttcccatcgactaccgtcctttcggcctcgccgttagggcacctcctaccctcggaccccgtattaaccgttcggaccgaacggtaccctttgggtccttccgggacgacggtccgggttccttttcccgaccccgttcttttacgtaccgtttacttagtcgtcagtcctactttccgacttcgttctacgtacctaccctcgtacgctactcgtccctaccaactacggaccctacctaccttaccgacgtacggtaccttaaccgaacgtacctacccctacccctaaacccaaaccgtaaccgacgtaacgtaaccgtccgtacccgccgtaccggtacccgaccggtaaccgttccggttacgtacggtcccgtacggttttaccgggtttaacccgttcccccggttttaactacccttcccgtttacccccgtactaccgtttccgttaccggtaccttacggttacccttaccgg

SEQ ID NO: 104801 - DNA, 855 bp, Homo sapiens
  misc_feature: GYAE6OF02GCNQI.17.34.D01.1.454.CMB.1.raw
tcagcgtagactagcacgaccggtgctcgatttagatcgtctgtgttgggtttggggaccaaaacaaccagattcctcctctaaagaagcccctggggagccacagcctcatcaccatggactggacctggaggttcctctttgtggtggcagcagctacaggtgtccagtcccaggtccagttggtgcaatctggggctgaggtgaagacgcctgggtcctcggtgagggttctcctgcaaggtcttctggaggtcaccttcgagcgactatagtttcaagttgggtgcggacggtcctcgtggactaaggccttgacgttggactgggaacgtctaccgtccctagttcgttgaacctacgaacctaaacgtccgaccaacgtaagtaacgtttccgacgggtcctaaggaccttaccgacccgtaaacgtaacccggtaccggaaacctaaaaactttaaaccgggaactaacgtaacgtttaaacgttaccgtacggtaacgtaccgtacggtaaccgtaacggtacccgttacggtaccgtaacgttacccggttaacggtaaccgggtaacccgtaacccggggttacctttacccgtttaacccgtttacccgttcgggtttaccggtaacggtaacgggttaaaccgttaaaccgttttaaaccgttaaacgttaaacccgttaccgtttacgttaaccccgttttacccgtttttttaacccgtaaccccgttttacccggtttaacgttacccgtttttaccgggttacccggggttaccccgttaaaccgggtttaaccccgggtaaccccccgggtttacccgtaaccccgggtttacccccg

SEQ ID NO: 104802 - DNA, 695 bp, Homo sapiens
  misc_feature: GYAE6OF02I3XTV.17.34.D01.1.454.CMB.1.raw
  modified_base (255)..(255): a, c, t, g, unknown or other
  misc_feature (255)..(255): n is a, c, g, or t
  modified_base (339)..(339): a, c, t, g, unknown or other
  misc_feature (339)..(339): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctccgtgacaaggtcttcgnggaggccaccttcagcgactatagtttcaagttgggtgcggtacgggcctgtggacaaggtccttaggagtggagtggggaagntccgtcctagtcgttgaccacaaccgaaactacgcaacgagtaacgttccagggacagaactcgaaccaacgtaacccggacggaaacctaaaagttaaaccgaaacctacgtaaagtttaacgtacgtaggtacgacgtagaaaccacggtacctaggtcaacgttcgacgaggtaaccgacgggttccttaccttacgtttcgtcggtaggcgtaaaggtagttaaacttaaccgttaataaccgtagtttaccgtccttttaacccgtttttacctacccctttacccgtttagttaccgtttccggtacggggtacccttaacggttacccgggtacccccggttaaccccg

SEQ ID NO: 104803 - DNA, 859 bp, Homo sapiens
  misc_feature: GYAE6OF02JX55P.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttccttctttggtgggtggcagcagctacaggtcgtccacgtcccaggtcctaggttggtgactaagtcgtggggctggaggtgaagacgtccgtgggtccgtcgggtggagggtctccgtagcgtaaggtcttcgtgggacggcctaccgttcgacggccgtacttaacgttacgtttaccgtaaggtttggggtacggccgggtacccgggttcccttacggtcgggtaaaccgtaacggggttccctttagggtaacggtagggtaacgggtacggggggtaaacggtaccgtttacccgggtttaccccttagttacccgggtttacgaacccctaaaccgtaaaccccgtaaaaccgtacccggacctaaaccggtaaaggttaaccggttacccggaacggggacctaacgtacctaaccggaacctaaccggtaacccggacgtaaacgtaaacgtaaccgaaactacgtaaagttaacgtcggtaggacgtacctaggaacctaccggacgttcgtacgtacgtacgacggaacggacccgtacgggttacctttacctacggtttcgtacggttaggaaccggtaaggttaacttaaacttacgttaactaccgtcttaccggtccctttttaaccttaccctaccccgtttaccgtttacggttaccgttacccgggtacgtacccggttaccggtacccgggttacccctaccgg

SEQ ID NO: 104804 - DNA, 858 bp, Homo sapiens
  misc_feature: GYAE6OF02JI2TY.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccacgtcccaggtccagttggtgcaatcgtgggctgaggtgaagacgccgtgggtcctcggtgagggttctccgtgaccgagggtcctttacgtgggacggcctaccgttcgacgcgtaacgttattagtttacctaagttggggtacggccggtaccgggtccttcgtacggaaccgaacgggtcccgttaggtggtaggtaggtacgggaacggtacgttaccgtaccccgttagttcggttacgaacctaccgaaacctaaacgtaccgacgtaacgaacgtaaccgttccgaagggccaggtacctaccgaacccgtaacgtaacccggtaccggtaacctaaaaccggttaacccgaaaccgtaacgtaaagtttaaacgtccggtaggtaacgtaccgtacgaaacgtacgtacccgtaacgttacgtaaccgtcggttaacggaccggtaccgtaacccggggttaccttttaccttaccgtttacggttcgttacgggtaacgtaacggggttaaagtttaaacctttaaccgtaacctttaacccgtaacgtttacccgtttaacccgttttttaaccccgttttaaccgtacccccgtttacccgttttaaccggttacccgtttacccgggtacccgggttaccttaaccccgggtaccccggttaaccccggttacccccgg

SEQ ID NO: 104805 - DNA, 603 bp, Homo sapiens
  misc_feature: GYAE6OF02JYA6E.17.34.D01.1.454.CMB.1.raw
  modified_base (101)..(101): a, c, t, g, unknown or other
  misc_feature (101)..(101): n is a, c, g, or t
  modified_base (258)..(258): a, c, t, g, unknown or other
  misc_feature (258)..(258): n is a, c, g, or t
  modified_base (327)..(327): a, c, t, g, unknown or other
  misc_feature (327)..(327): n is a, c, g, or t
  modified_base (428)..(428): a, c, t, g, unknown or other
  misc_feature (428)..(428): n is a, c, g, or t
  modified_base (490)..(490): a, c, t, g, unknown or other
  misc_feature (490)..(490): n is a, c, g, or t
tcagcgtagactagcacgaccggtgctcgatttagatcgtctgtgttgggtttggggatcacaaaacaaccagattcctcctctaaagaagcccctgggancacagctcatcaccatggactggacctggagttcctctttgtggtggcagcagctacaggtgtccagtcccaggtccagttggtgcaatcgtggggctgaggtgaaagcgcctgggtcctggtgagggtctcctgcaaggcttctggaggcaccttnagcgactatagttcaagttgggtacgcgacgggtctacgtggacaaggccttggagtggagtgggaagngtcgtcctagtcgttgacacgaccaaacgtcgcaacgagaacgttccgagggacagactcaccaacgtaccgacgaacaacgtaacgaacaactagttaancgtaggagactagaacgagtacctagtacacgtcgagtacggacgacggtacttctaccgtnttcggtagacgtagaggttaaattacgtaatacctagttacgtcctttacctttaccgaccctttccgtattaccgttcggtacggtcctacggttaccggtacccccgttcg

SEQ ID NO: 104806 - DNA, 730 bp, Homo sapiens
  misc_feature: GYAE6OF02HPL2M.17.34.D01.1.454.CMB.1.raw
  modified_base (339)..(339): a, c, t, g, unknown or other
  misc_feature (339)..(339): n is a, c, g, or t
  modified_base (525)..(525): a, c, t, g, unknown or other
  misc_feature (525)..(525): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttccttctttgtggtggcagcagctacaggtcgtccacgtcccaggtccagttggtgcaatcgtgggctggaggtagaagacgcctgggtcctcggtgacggtctcctgacgaaggtcttcgtaggaggcctaccgttgacggcgtactagttagttactaagttgggtagcggaccggtccgtcgtcggaacgtaacggtccgtaggngtggtagtagggaacgacgtccgtacccgtagttcgtacgaacacgtaaccaaacgtcgacaacgacgttaacgtaccgacggtacgacgtaccgtaccgaaccgtaacgtaaacccggacggtaaaccgtaaaaacgttaacccgaaacgtaaccgttaaacggttaaactacccggttacgganaccggttacgaaacgtacgtaacccgttacgtatacgtactagggaccgaacgtaccgggtacgttcgttacttacgttccgtagaccggtaagtaagttaacttacgaacttaaccgagtacgttccttacctttaccgttaccctccgttaacgttacgtcgtacggccgttaggacccggttacccgtaccgccgttacccg

SEQ ID NO: 104807 - DNA, 707 bp, Homo sapiens
  misc_feature: GYAE6OF02HB32A.17.34.D01.1.454.CMB.1.raw
  modified_base (96)..(96): a, c, t, g, unknown or other
  misc_feature (96)..(96): n is a, c, g, or t
  modified_base (230)..(230): a, c, t, g, unknown or other
  misc_feature (230)..(230): n is a, c, g, or t
  modified_base (423)..(423): a, c, t, g, unknown or other
  misc_feature (423)..(423): n is a, c, g, or t
tcagcgtagactagcacgaccggtgctcgatttagatcgtctgtgttgggttggggtacgatttgatgttacctgatgcttagaggtcttttccgnggaagcgagggctatttgttgtacttcagcacgtagtgcctcgtcatcacgcctcagtccttgtacttttccggatttgaccgttacggaaacacgcctaaccgcttaaaccggacaaccgtcgacccgacaanactatccttctacccgtcccccttgcacgttaacaccgaagtacgagtaattacttaacctgttaccatcgactacgtccttacgctcgtcgttaggtcacgtcaccctgaccctaattacgcgaacacggtacctgtactcggcgagcggtctttcaccggtcttaacgtgttacctagtcgtacacgtacncgttacgcttaatgttacgaataaccctcgacgtaccatccgtacctacgaccgatacgtaacctacgttacaccgtaaagtccttaagaaccgtacgtaccctacccgtaaacctaacgacgactaaccgtaacggtctaccgtacaccgacccggactaggtttaccgtccggttacgaccgttaagggttacgttaaccccggtttccgtttacgaaccgttttccctaaacccggtcccgttagtaacccgttaccaacgtttacggttccctaaccggg

SEQ ID NO: 104808 - DNA, 1137 bp, Homo sapiens
  misc_feature: GYAE6OF02H4DWP.17.34.D01.1.454.CMB.1.raw
tcagcgtagactagcacgaccggtgctcgatttagatcgtctgtgttgggtttggggacaaaacaaccagattcctcctctaaagaagccctgggagcacagctcatcaccatggactggacctggacgttcctctttgtggtggcagcagctacgaggtcgtccagtcccaggtcctaggttggtgacaagtcggtaggggctggaggttagaacggaccgtccgttcggggtacccgttcgggtacggtacggggttcctcccgtaggcgtaagggtccttaccggtagggacggtaccctaaccgtttcgaacgggtaccgtaaccgtttaagttacgggtttttaaccaagggtttgggggtaccgaccggggtaccgggtaccttcggtacgggaaacgtaacgggttccctttagggtacggttcggtaacgggttacgggggaaaacggtttccgtttacccggttaccccggtttaaggttttcccgggtttaacggaaccccgttaaacccgtaaaaccccggtaaaacgttaacccccggttacggaaaaccccgtaacggggttaaacccggttttcccgggaaacgggggtaccttaaaaccggtaaccccggtaaccttaaacccccggtaaaacgggtttaaaacccccgggaaaccgggttaaaaccgttaaaaaaacccggtttttaaacccggaaaaccgttaaaccgttaaaacggggttttttaacccgccgggtttaaaacgggtaacccgttaaccgggtaaaacccgtaaaccgttaccgggtaccgtttaaaccggttcccgttaaacgtttcccggggaaacgggttacccggggaacggtttaaaccccgggttccccttttaaggtttacccccgtagggttacccggggttacgggttaaacggttaaaccggggtttaagtttaaaaccccgttaaacggttaaaccgtttaacgaaccccgtttttaccggtttaccccttttttttaacccgggttaaccccttaccccggttttaaccggtttaacccgtttacgggttaccggccgggttaacttaacccggggttcccccggggttaaaccgttcccctttaccgttaccccgg

SEQ ID NO: 104809 - DNA, 936 bp, Homo sapiens
  misc_feature: GYAE6OF02HUYPZ.17.34.D01.1.454.CMB.1.raw
  modified_base (159)..(159): a, c, t, g, unknown or other
  misc_feature (159)..(159): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacnggtagtccacgtcccaggtccagttggtgcaatcgtggggctgaggtagagacgccgtgggtcctcgggtgacgggtctcctgcgaacggtcttcgtggagtcctaccttcgacgcgtacttattacgttactaagttggggtcgacggtacgggtccttacgtggaacgtaacgggtccttggtacgggttaggacggtaggggtaacggtacgttcccggtaacccgttagttcggttacgaaccctaccgtaaacccgtaaaccgtaccgacgtaaaccgtaacggtaaccggttaccggacgggtaccgtaacggtacccgtaacccgaaacccgtaacccggtaaaccccggtaaccggtaaaacgttaaaaacccgttaaccgaaaaccgtaacggtttaaacggtttaaacgttaccggtaaacggaacgtttacccgtaaacggtaaacccggtacgttaaccccggttacggtaccgttacgttaaccgggtacgggtaacccgggtaaaacccggtacccgggggttttaaccctttacccggtttaactttcggggttaacgggttaccggtaacggggtaaagttaaacgttttaaaatacccggtttaaaaccttcccggttaaccgtttaccgttaccctttttaaccccgtttttaacccgtccccttttaaccccgggtttagttaccccggtttacggggtaaccccggtttaaacccggttaccgggggttacccccggtaccccggttaaacccccgg

SEQ ID NO: 104810 - DNA, 863 bp, Homo sapiens
  misc_feature: GYAE6OF02IJU8D.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcgaatctggggctgaggtgaagacgcctgggtcctcgggtgacggggttctccgtgacgaacggtcttacgtggaacggcctaccgttcaggccgtaacttacttaacggttttacaaagtttcggggtacgccggacggggtccttcgtcggaaactaacgggtcctttaggacggttaggaggtaggggaaacggtcgttccggtacccttaagttccggtttaagaacctaaccgtaaaccaaaacgttacggaccaaacgtaacgtaaacggttccgaacggggtacaaacggtacctaccaaaacccgtaacggtaaacccggacggtaaaactaaaaacgtttaaacccgaaacctaaacgtaaacgtttaaacgtacggtaacggtaacgtaccgtagtaaaccgtacgtacgttacgtactaacgttaccgtagggtaacggaaccgtaaccgggttcctttaccgttaccgtttcgtacggttacgggaccgttaaagggttaaactttaaaacgtttaaccgttaaacgttaacccgtaaccgtttacggttaacccctttttaaccccgttttaaccctaaccccttttacccgtttaacgttaccggtttacggtaccggggtaacccgtaacggttaccccggggtaacccccgttacccgg

SEQ ID NO: 104811 - DNA, 825 bp, Homo sapiens
  misc_feature: GYAE6OF02JWP5C.17.34.D01.1.454.CMB.1.raw
tcagcgtagactagcacgaccggtgctcgatttagatcgtctgtgttggggtttggggacaaaacaaccagattcctcctctaaagaagcccctgggagcacagctcatcacatggactggacctggagttcctcttgtggtggcagcaggctacaggtgtccagtcccaggtccagttggtgcaagtcgtggggctggacggtgaacgcgtccgtgggtcctcgggtgacgggtctccgtggactaaggcttctgggacgtctaccgttcgagccggtacttagttacgtttcgaagtttggggtcgccggtacgggtcctcgttacgggacgtaacgggtcctttagggaacggttgggacgttacggggaaacgggtctttaccggtacccgttaggttaccggtttcggaaaccttaacccgaaccgtaaaccgttaaccggactaaccgaaggttaaccggtttaccgaacgggggtacctaaggtaaccctacccgtaaccgtaaacggttaaacccgggaaccggtaaacgttaaaaacgtaaccggaaaccgtaacggtaacgtttaaaccggtacgttcggaaacgtacggtaacgtaaaccggtactaccggtagtcgtaacttaccgagggtaccgaacggtacggtctttacctagttacgcgtagtaccgggaagtttacgtaacgttaactactaccgttaacgtccgttaccgttttaaccttccgtaccgtttaccgtaccgttacccgtttacggaccgggtttacccacggttaaccccggttacggtaccccgttaccgttacccg

SEQ ID NO: 104812 - DNA, 860 bp, Homo sapiens
  misc_feature: GYAE6OF02IWRJT.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgacaaggcttacgtgggaggccaaccttcgagcgactattagtttcaagttgggtgcgacggtcctcgtggacaaggccttaggagtgggagtagggaagggtactccggttccccgttaagttccggttacgacaaccgtaacccaaaaccgttaccgaccaaacgtacgtaaacggtttcccgaaggggtaccaacggaacccttacgaaccccgtaacgtaaaacccccgggaccgggtaaaccaaaacggttttaaacccggaaaaccctaaccggtaaaacgtttttaaacggtaccgttaacgggaacggttaccgttaaacgtaaaccgacgggttaccctttacggtaccgtacgttacgtacgggtaacggtaaccggtacccgggtaccttttacccgtttaccgttaccgtttggtaaccggtacgggtaacggttaaacgtttaaacggttaaaccttaacgttaaccgttacgttaccgttaacccgtttttacccgttttaaaccgttacccccttttacccgttacccggtttaacccgtttaccgggtttccgggggtaaccctttaaccgggtttaccccgggtaaacccccgggtttacccccgg

SEQ ID NO: 104813 - DNA, 821 bp, Homo sapiens
  misc_feature: GYAE6OF02IMGCQ.17.34.D01.1.454.CMB.1.raw
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (754)..(754): a, c, t, g, unknown or other
  misc_feature (754)..(754): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacgaggtgtccagtcccaggtccaggttggtgactaatcgtggggctggaaggtgaaacgcggcccgttgggtccttcggggtagacggggttcctccgtgacgtaaggtctttacgngggacggcctaaccttcncgacggtactattacgttataagttgggtacgcggaccgggtcctacgtagggtacgaacgggtccttttaggacggtagggtagttaggggaaacggttacgtccggttaccccgttaaggttaccggtttacggaaaccctaaccgtaaaacccgtaaaaaccggttacccggaaccaaaccggtaacgggtaaacggtttacccggggaaaccgggaccggtaaaccggtaccgtttaacccaacccggtaaaaccgtttaccccgggaaaccgggtaaacccgtaaaaaacggtttaaaccgaaacccgttaaacgtaaacggtttaaaacgttacccgttaagggaaccgtacggttaacggaaaccgtaacggttaccgtcggtactaacgtacgtacggaacgtaccgtaacgggtcttacttacgtacgtgcgtagagtaagtaattacaanactacgtctattacctttacacccgttcctatacgttcggtcgtaccgctacccgggtacctaccgg

SEQ ID NO: 104814 - DNA, 1076 bp, Homo sapiens
  misc_feature: GYAE6OF02JNZ6R.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctcttgtggtggcagcagctacaggtgtccagtcccaggtccagttcggtgcaatctgggctgagtgaacgacgcctggggtcctcggtgacgggttctcccttggaccgtaaggccgttttcgtacgggggcggtacccgtaacccttttcgaaggtccgtaacctaaagttttaacgttttaccaaaaaggtttttggggggttcgacccgggtaaaccggggggtcccctttacccgttaggggggttaaccccgaaaacggggttcccccttttaagggggacgggtacgggggtaaaagtttaccgggggggaaaaaggggttcctttccccggggtttaccccccttaaaagggttttccgggttttaaaacccggaaccgaaacccccggtaaaccccttaaaaaacccggttccccgtaacggaaaccggtaaacggttaaaaccggggtttttccccgaaagggggtttacccaaacggtaccttttaacccgacccgtaaaacgtttaaaccccggaccggggaaacccttaaaaactttaaacccgggaataaacccgtaaaggtttaaaaacctttttccccgggaagggtaaaccgtcccggttaaaacgggtaaaaccccgtccggttaacccgtttaggtaacccgtttaaccggttacccgttaaacggggtaaccgggttaaacccgggttacccgggtttaccttttaaccggtttaacccgttttagttccggtaacgggtacggtaaacggttaaacttaaaccgtttaacttaaacgttaccggtaacccgtttcgttaccccgttttacccttttaaacccttaccccggtttacctttaacggttacccgttaccgggttacccggtccctttaaccgggttaaccccgggttaccccggttacccgtcccgttaccccg

SEQ ID NO: 104815 - DNA, 628 bp, Homo sapiens
  misc_feature: GYAE6OF02G02CO.17.34.D01.1.454.CMB.1.raw
  modified_base (251)..(251): a, c, t, g, unknown or other
  misc_feature (251)..(251): n is a, c, g, or t
  modified_base (330)..(330): a, c, t, g, unknown or other
  misc_feature (330)..(330): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgacgggtctcctgcaaggtcttcgngggacggcaccttcagcgactatagtttcaagttgggtgcgacgggctcgtggacacggccttgaggtggagtgggagntccgtcctagtcgtgacacgaccaaactacgacacgagacgtccgagggccagactaccaaccagtaacccggacgaacaaactaacgaaaccaacgtaagttaactcgtaggacgtctacgaacacgctacgtactactcgtaggacgaccgcggtccttacgtacttcgtagtcgacgtaggtagttaattaactataccgtctacgttcctttaccgttttaccctacccgtttaccgttcgttaccgttccggttaccggtacccgttacggtacccgggtaccccgttacccg

SEQ ID NO: 104816 - DNA, 695 bp, Homo sapiens
  misc_feature: GYAE6OF02GQDCF.17.34.D01.1.454.CMB.1.raw
  modified_base (253)..(253): a, c, t, g, unknown or other
  misc_feature (253)..(253): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctccgtgcaaggtcttcgngggacgccaccttcgagccgaacttagttagtttcaagttgggtcgcgtacgggcctcgtggacaaggtccttggagtggagtagggaagactcgtcctagtcgttagacaccaacaacgtacgcaacagtaacgtccaggacagacctacaacaacgtaaccgacgtaacaaacgtaacgaactactaagttaacgtacgtaggacgtactaacgaacgtaccgacgttacgtactacgttacgtacgaacggaccgtacgggttaccttaccgtaccgtttcgtcggtacgaacgttaggttaaacgttaaacgttacttaacgtaacttaccgttagttacccgtttttacccttttaaaccgtacccctttaccgttttacggtaccctttcggttaaccggtacccgtacggttacccggtaacccccggttacccg

SEQ ID NO: 104817 - DNA, 865 bp, Homo sapiens
  misc_feature: GYAE6OF02IPZ45.17.34.D01.1.454.CMB.1.raw
tcagcgtagactagcacgaccggtgctcgatttagatcgtctgtgttgggtttgggatcacaaaacaaccagattcctcctactaaagaacgcccctgggagcacagctcatcaccagtggactggaccgtggacgttccttcgtttggtggtggcagcgagtctacgaggtcgtccacgtacccgaggtccgtaggttggttcggtacaacgttcggttggggcttagggtagggtacggaacggtaccggtacccggtttcggggttacccgttcggggtagggtacgggttcccttccgtacggacggtaaccggttccgtttcggtcgggtacggtacctacccgttacgtaacggaccgttaaacgtttagtttacggttttacgtaaggtttcggggtaccggtcggtacccggggtaccttaccgtacgggtacgtaaccgggttccgttaggtacgggtagggaacgggtcggggtaaacggtcgttaccgttaccgttacgtacgttacgacctaaccgaacctaaaccgtacgacgtaacgaagtaaccgtacgacggacacgaccactaccgtaacgtaaccggaccgtaactaaacgttaaccgaacaacgtaagttaacgtacgtaggacacgacgtaaccgtcgtactcgtacgacgtacgtaaggaccggacgtaccggttacttcgttacgttagtccggtacggtacgtaacggttacttaaaccgttatttaactaccgtcgttaccgtttaccttttaacccgttttacccgtaaccgtttccgttaaccttcggtttacgggacccggttaccggtttaaccgtaccccgggtacccgtacccgg

SEQ ID NO: 104818 - DNA, 819 bp, Homo sapiens
  misc_feature: GYAE6OF02GG8AZ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccgaggtccagttggtgcaatcgtggggctggaggtagaacgacgtccgtcggggtaccctcgggtgacgggttcctccgtggacgaagtccttcgtggaccggcctaccttcgacggcgtaactattacgtttacgtaagtttcgggtcgccgggtaccgggtcccttcggtacggaaccgtaaggtccgttggagtgggacgtaggggaaaggtcgttcccgtacccttaggttccgttacgaccaacctaacctaaaacctacgaccgaaacgtacggaaccgttaccgaacgggcaacgtaacccgtacaacccgtaacgtaaccccggacgaaactaaacgttaaaccgaaaccgtaacgtaaggtttaaactacggtacggacgtaacgtaacgaaaccgaccgtaccgttagtaccgtaattaccgtaggaaccggaacgtaccgggtaccgtttaccgttaccgtttcgtaaggttccgacgggtaacgttaaagttaaaccgttttaaccgaacgttaccgttaaccgtaccgtttaacccgttttacccttttacccgttaacccctttcccgtttacggttacccgtttaccgggtccgggtacccttaacggtaccccgggttaccccgtaccccg

SEQ ID NO: 104819 - DNA, 702 bp, Homo sapiens
  misc_feature: GYAE6OF02IGHW3.17.34.D01.1.454.CMB.1.raw
  modified_base (98)..(98): a, c, t, g, unknown or other
  misc_feature (98)..(98): n is a, c, g, or t
  modified_base (155)..(155): a, c, t, g, unknown or other
  misc_feature (155)..(155): n is a, c, g, or t
  modified_base (159)..(159): a, c, t, g, unknown or other
  misc_feature (159)..(159): n is a, c, g, or t
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
tcagcgtagactagcacgaccggtgctcgatttagatcgtctgtgttgggtttggggacaaaacaaccagattcctcctctaaagaagcccctgggancacagctcatcaccatggactggacctggagttcctctttgtggtggcagcagctanagtntccagtcccaggtccagttggtgctatcgtgggctggagtnaagcgtccgtggtcctggtgacgggtctccgtgacgtaagtcttacgnggagtcctaccttcgagacgtactattagttcaagttgggtcgcggacggcttcgaggtacacgtcgttgacggttggagtaggaagtcttaccgtcctagtcgtagacctaacaccgtaactcgacacgtaacgtacgtccggaggcaacggtcctaccgaactaaacccgtaaccgacgtaaacctaaaagttaaccgaacgtaaactaggttaacgtacgtaacgggtacgtacgttaacgaaacggtccgtaccgtacgttaccgttaacgtacgtacgggtaacgtaaccgtccggtactttccgttacgttccgtaggtcgtaacgtaagttaactaacgttactaacttacgtacttaccgttactttaccgttccgtaaccttccgtaacgttccgtacggtccggtacgtaccggttacccgtacccggtcctacccgttacccg

SEQ ID NO: 104820 - DNA, 910 bp, Homo sapiens
  misc_feature: GYAE6OF02IN61K.17.34.D01.1.454.CMB.1.raw
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctctgcaaggtcttcgtggacggcaccttcagcgactagtagtttcaagtttgggagcgtacgggccctcgtggaacgaaggtcccgtttaggacggttgggaacgttaggggaaggtactccggtaccccgttagttccggtttagaaccaccgaaccctaaaaccgttaccggcctaaccgaacgtaaacgtttacccggaacggggtaccacggtaaccttacgaacccgtaacgtaaaccccgacgggaaacctaaaacgtttaaaccgaaacctaacttaaacgtttaaactccggtacgggtaacgtaccgttaacgaaaccgacggtccccgtttaaggtaacccgtaacgtttacgttaacggggtacgggtaaacccgtaccgggggtttacctttaacccgggtttaaccgttttacccggttacgggttccggggtaaaccggttaaccggggttaaaacgttttaaaacccgtttaaaccgttaaaacggttaaacccttaaccgtttaccgggtttaccccgtttttaaccccgttttttaccccgttaaacccccttttcccggtttacccgttaaccccgtttttcccggggttaccggggtacccccttaagggttaaccccggggtaacccccccggtttaccggtacccccggtttaacccccg

SEQ ID NO: 104821 - DNA, 846 bp, Homo sapiens
  misc_feature: GYAE6OF02GFT44.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtcctagttggtgcaatcgtggggctgaggtgaagacgccgtgggtcctcgggtgagggtcctccgtgacgaaggtcttcgtgggacggcctaccttcgaggccgtaacttacgttagttttacctaagtttcggggtagcccgggacgggtccctaccgttagggaaccgaaacgggtcccgtttaggtaaccggttggggaaggttagggggaaacgggtacggttaccggttccccgtttaagttcccgggtttaaggaaccccaacccgtaaacccgtaaaaacctacccggtacaaaccgtaacgggtaaaccgtttaccccggaaacgggggtccaaaggacccttaaccgaacccgtaaaccgttaaacccggggaacccgggtaaaaccgtaaaaacgtttaaaccgaaaccgtaacgtaaaacggtttaacgtaccgttacggaacgtaccgtaacgtaacggacgtaccgtcgtactactccgtagaacggtacggtaccggttcttaccttacgtacgttgtacggtagtaaggtaacgtttaaacttacgttaactaccgtactaccggtttacctttaccgtttaccctacccgttacccgtttcgtacgttccggtacggttacccgtacggttacccgggtaccccgtttaccccgg

SEQ ID NO: 104822 - DNA, 729 bp, Homo sapiens
  misc_feature: GYAE6OF02JKSPI.17.34.D01.1.454.CMB.1.raw
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctcttttgtggtggcagcagctacaggtgtccagtcccaggtccagttggngcaatctggggctggaggtgaagacgcctgggtctcggtgaggtctccngcaaggcttcnggaggcaccgttcagcgaacttatagtttcaagttgggtgcggacggtcctgtaggacgaacggtccttggaggtggagtgggaaggctcggtcctagttgtacgacaacctacctaaactcgacacgaagtaacggttccgaagggcacggactacgaaccacgtaaacccggcgaaacgtaaaacttaaccgaaactaacgtaacgttaactacgtaacggacgtacgtacgaaacgaacgtaccgttacgtaccgtacgttactacgggtaacgtaaccgacgggttaccttccttaccgttaccgtaggtaccggtacggtaacggtaaacttaacgttaaccttaacgtaaccgtaccgttcggttaccttttaccccgttttaaaccgtacctttcccgtttaacgttcccgtttacggtaccgggttaccgtaacccggttacccgggttaaacccggtccggtacccgttaccccgg

SEQ ID NO: 104823 - DNA, 764 bp, Homo sapiens
  misc_feature: GYAE6OF02I1WRF.17.34.D01.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
tcagcgtagactagcacgaccggtgctcgatttagatcgtctgtgttgggtttggggatcacaaaacaaccagattcctcctactaaagaagccccgtgggagcacagctcatcaccatggactggacctggacggttcctctttggtggtggcagcagctacgaggtgtccgagtcccgaggtccaggttggtnacatcgtgggctggaggtgaagccgcgtggtcctggtgnggttctccgngcaggtctgtggnggctacctgagcgtactagtgttcaagttggcggtccgacgggcctcgtacgggacaggtccgtggtacggtagggagtagggaggtctccggttacctattccgttagaccgttaaccgaaccgtaaacgtaccgtaccgaacgtaacggtaacggttccggtaacggggctacggtaacccgttcccgaaacccgttaacccgaacccggtaccgggaaaccgttaaaaacggttaaaccgtaaaccgaaaccggttaaaccgtttaaacgttaccgggtacggaccgtaacggtaaacgtaaccggtaacgttacccgttagtacctaacgttaccgtaggtaacggtaaccgtacggttaccgtttcccttaaccgttgtcggttacggtacgggttaacgtaaatttacgtaacctagtacctactccgtacttttacccgttacctccgttaccgtacttcggacggttcccgacgtacggttaccccggacgttccccgg

SEQ ID NO: 104824 - DNA, 708 bp, Homo sapiens
  misc_feature: GYAE6OF02JXL44.17.34.D01.1.454.CMB.1.raw
  modified_base (340)..(340): a, c, t, g, unknown or other
  misc_feature (340)..(340): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggtcttcgtggaggccaccgttcaggcgactattagtttcaagttgggtcgcggacgggtcctcgtaggacaaggccttgaggtggagtggggaaggtntcgtccctagtcgttagacaactaccaaacgtaccgacaacgtaagaaacgtttccggaacgggtacaacggactaccgtaaccaacgtaaacccgggcggaaacctaaacgttaaaccggaaacctaaccgtaaaggtttaactaccgttaggacgaccgttaacgaaccgtacggtaccttacgtctaacgttacgtacggaacggtaccgtacgggtacttaccgttacgtttacgtcggtacgtacgtaaggtaagttaaacgtttaactacgtaactcgttacgtaccttttaccgttttaaccgtaccttcccttacgtaccgttcggtaccggtacctacggtaccggtaccccgtacccg

SEQ ID NO: 104825 - DNA, 719 bp, Homo sapiens
  misc_feature: GYAE6OF02FSNCR.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgagacgcctgggtcctcggtgagggtctccgtgcaaggcttcgtggacggcaccttcagcgactatagtttcaagttggggtgccggtacgggcctcgtgggaccaagggtccttggagtggagtggggaaggtattccgtacctagtccgttagaccaacaaccaaactacgaccaacacggtaacgttccgaagggcaacggactaccgaacctaacgtaacccgacgggaaactaaacgttaaaccggaaaccaacgtaagtttaaactcgttaggaacgtaccgttacggaaactaccgtaccgttaggtacctacgttaccgtacggacggtaccgaccgggttcttaccgttacctttccgttggtcggtacgtaacggtagttaacgttaactaacgttaccgtacgttacgttaccctttacctttttaacctacccgtttacccgttcgttacccgttcggttaccggggtaccctacggttacccgggtaaccccggttaccccg

SEQ ID NO: 104826 - DNA, 541 bp, Homo sapiens
  misc_feature: GYAE6OF02GGKIA.17.34.D01.1.454.CMB.1.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (399)..(399): a, c, t, g, unknown or other
  misc_feature (399)..(399): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtncgacgggcctctggacaaggccttgagtggatggggaaggatcgtcctatcgttgacacaccaaactacgcacagaagttccaggcagactcacataaccgcgacaaataacgaanacataatctgagactgaacagctgcatctagagacgacgggcttacgtacttctgtgtcgagagtaattactatacactgtcttccgttttaccacccttaccgttcgacgttcgtacgggtccacgtcggacccgtacccg

SEQ ID NO: 104827 - DNA, 847 bp, Homo sapiens
  misc_feature: GYAE6OF02H7JDS.17.34.D01.1.454.CMB.1.raw
  modified_base (144)..(144): a, c, t, g, unknown or other
  misc_feature (144)..(144): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggagttcctctttgnggtgcagcagctacgaggtgtccagtcccaggtcctaggttggtcgcaagtccgtggggctcggaggtgaaagccgccgtgggtccctgggtgacgggtctccgtgacgtaacggtcttcgtaggaggtcctacgttcgagaccgtatacgttacgttacgtaaggttcgggtcgtcggaccgggtccttacggtacggtaacgtaacggtccgtttaggacggtagggacgttacgggaacggtacgttcccggttaccgtacggttccggttacgaaaccgtaaccggtaaaccgtaaaacgtaccgaccctaaacggtaaccggaacggtttaccgaacgggtactaaaccgtcgtaaccctaaacgtaacggtaacccggtaacggtaaaccgtaaaacgttaaaccgaaccgtaaaccgttaaacgttaaacgtacggtacggtaacgtaccgtaacgtaaccgacggtaaccgttacgttaaccgtacgtaaccggtaggaacgggtaccggtaaccggttacctttacgtaccgttacggtcggtacgttacgggaacggttaaagtaaccgttaacgtaacgttacgtaccgttaccgtaaccgttttacccgtttaccgaaccccgtttaccgttacgttaaccggttcggtaccgggtacccgtaacgggtttaccccggaacccgtttaccg

SEQ ID NO: 104828 - DNA, 770 bp, Homo sapiens
  misc_feature: GYAE6OF02IV8QM.17.34.D01.1.454.CMB.1.raw
  modified_base (160)..(160): a, c, t, g, unknown or other
  misc_feature (160)..(160): n is a, c, g, or t
  modified_base (187)..(187): a, c, t, g, unknown or other
  misc_feature (187)..(187): n is a, c, g, or t
  modified_base (305)..(305): a, c, t, g, unknown or other
  misc_feature (305)..(305): n is a, c, g, or t
tcagcgtagactagcacgaccggtgctcgatttagatcgtctgtggttgggtttggggatcacaaacaaccagattcctcctctaaagaagcccctggagcacagctcatcaccatggactggacctggaggttcctctttgtcggtggcagcagctacnggtgtccagtcccaggtccagttggtncaatctggggctggaggtgaacgacgccgtgggttcctacgggtggacggggttctccgtgtcaacggtcttcgtggacggcaccttcgagcggtacttatagtttccaattgggtcncggacggtcctcgttggaccgaagggtcccgtttagacggtggagttacggggaaggtactcggttccccttaagtacggttcgaacctacgaaccgaaccgtacgccaaactacggtaacgttccggaacgggctaacgggtacctacgtaaccaacgttaacccggacgggtaacaaacgttaaccgaaactaacgtaacgttaaacttcggtacggtacggtactacggtaaacaccggtccttacgtacgtactacggtacggtacggtacccggtaggtcccgttagttaccgtttcggtacggtaccggtcggttaaacggttagttaaacgttaaccttaagtaaccctggtttaccgtacccgtttacctttttaaccggtaccccttaccgtttaccgttacccggtttacggaccgggtccgttaacggttaccccgggttacccgttaccccgg

SEQ ID NO: 104829 - DNA, 659 bp, Homo sapiens
  misc_feature: GYAE6OF02GRMR7.17.34.D01.1.454.CMB.1.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (566)..(566): a, c, t, g, unknown or other
  misc_feature (566)..(566): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggaggttcctctttgtggtggcagcagctacgaggtcgtccagtcccaggtccagttggtgacaatcgtggggctggaggtgaagacgccgtgggtcctcgggngagggtcctcctggcaagcttacgnggaggcaccttcagcgactatagtttcaattgggtcgcgacgggcctcgtggactaaggtccgttagaggtggataggggaacgtagtcgtaccctagtcgttagacaccaaccgaaactcactaacacgtaacgttccgaaggctacgaactacccaaccaacgtacccggacgaacgtaaaattaaccgaacaagtaacgttaagtctaggacgcttaacgaaccgcgtccgttactactcgtaacggaggaccacgggttcttacctacgttacgtcgttggaggtacgaattaattaccgtaanaacttcgaccgtctttaacccgtttactaccccgttcccgttagtaccgtttcgtcggggtaccttacgggtacccgtacccggtcctacccg

SEQ ID NO: 104830 - DNA, 589 bp, Homo sapiens
  misc_feature: GYAE6OF02IFNDM.17.34.D01.1.454.CMB.1.raw
  modified_base (287)..(287): a, c, t, g, unknown or other
  misc_feature (287)..(287): n is a, c, g, or t
  modified_base (332)..(332): a, c, t, g, unknown or other
  misc_feature (332)..(332): n is a, c, g, or t
  modified_base (397)..(397): a, c, t, g, unknown or other
  misc_feature (397)..(397): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgacgggtctcctgcaaggtcttcgtggaggcaccttcagcgactatagtttcaagttgggngcggacgggcctcgtggacaaggcctttgagttggatggggaagntccgtcctatcgttgacacaccaaactcgcacagaagttccagggcaagactcaccataacccgnggaacaaattaacgaacactaagttaactactaggagctagaacagccttagtcataccgtgacggacgacggctttacctacttcgtgtgacgagtaagtaacttactaataacactagtcctttaccgttttaacctcccttacccttcgtacctttcggtcgggacctagtacccggtacccgtacccg

SEQ ID NO: 104831 - DNA, 752 bp, Homo sapiens
  misc_feature: GYAE6OF02FYL5M.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgacgggtctcctgcaaggcttcgtggacggctaccttcagcgactatagtttcaagttgggtgcggacggcctcgtggacaggtcctgagtggatggggaacgatccgcctagtcgttcgacaccaacctaaacgcgacaacacgaacgttaccgagggacaacgacctacaaccgaacgtaaacccggcgggaaactaaaacgttaaaccgaaaccgtaaccgtaaagtttaaacgtacggttacggaacgtaccgtaacggtaaaccgacgtaacccgttacgtacctaagttaccgtaacggaacgggtaaccggtaacgggttacctttacgttaccgttttccgttggtacggtaccgggtaaggtaaacggttaaactttaaccgttaacgtaaaccgtaccgttacgttaaccttttaccccgtttttaacccgtaccccctttacccgttttaccgtaaccgttttcccggtaacgggtacccgtaacgggttacccccggtaaccccggttaccccg

SEQ ID NO: 104832 - DNA, 782 bp, Homo sapiens
  misc_feature: GYAE6OF02FWC5U.17.34.D01.1.454.CMB.1.raw
  modified_base (202)..(202): a, c, t, g, unknown or other
  misc_feature (202)..(202): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtnaagacgcctgggtcctcgggtgagggttcctcgtgcaagggcttacgtgggagtccaaccttcacgcgtactatagttttcaagttgggtcgcgacgggtcctctggacgaacggtcttggagtcggagtagggaaggtatccgtaccctagtccgttagaccacgaccaacgtacgcacgagtacgttaccgagggccagtaccgtacacgactaaccggaccggaactaaaacgttaaccggaactaactaacgtttaacgtacgttaccggaagtacccgttaagaaacctaacggtcccgtacgtacgtactaccgttacgggaacgggtaaccgtacggggttacctttaccgttaaccgttaccgggtttaggtaccgggtaccggttaaggggtaaaccgtttaaacgtttaaacccgttaaactaaccggttaacccgttggttacccttttaacccggttttttaacccaccccgttttaccccgtttacgtacccggttttcggtaacccggggtacccgttaacccggtacccgggtaaccccgggtttcccgaacccggtttaccccg

SEQ ID NO: 104833 - DNA, 749 bp, Homo sapiens
  misc_feature: GYAE6OF02F0HVQ.17.34.D01.1.454.CMB.1.raw
tcagcgtagactagcacgaccggtgctcgatttagatcgtctgtggttgggtttggggacaaaacaaccagattcctcctctaaagaagcccctgggagcacagctcatcaccatggactggacctggaggttcctactttgtggtggcagcagctacaggtgtccagtcccaggtccagttggtgcgaatccgtggggctagaggtgaagacgcctgggtcctcggtgacgggttctccgtggctaaggcttcgtggaggcaccttcagcgactagtacgtttcaagttgggtgcgacgggcctcgtaggaccaaggtcctagcggtgagtgggaacgtctaccgtacctgtcgttagaccacgtaaccaaaccgtcgaccagtaaggtaaccgttaccgaggaccctaagaccgtaccaacccgtaaacgtaacccggcggtaaaacctaaaaccgtttaaaccgaaccgtaaacgtaaacgtttaaacgtaccgtaggtacgggtactacggtaaaccgactaccggtcgttaaccgtacgttacaacgggtacggaaccggtaccggtaccttacgttaaacgttcgtaccggtgggaacgtacggtaaagttaaactttaactaattaaccgtaccttacgttacccgtttacctttttacccaaccgtttccccgttagttaccgtttcggaccgggtacctaaccgtaccccgggtaacccggttcccgtacccggttaccc

SEQ ID NO: 104834 - DNA, 806 bp, Homo sapiens
  misc_feature: GYAE6OF02FJT8O.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggttctcctgacgaaggcttcgaggaggcacccttgacgcgactagtacgtttcaagttgggtgacggaccgggtcttcgtaggacaacggtcctttaggaggttacgggagtacgggggtaacggtacgttccggttaccccttagttccgtttacgaaccgtaacctaacccgtaaaaccgtaccgacctaaccgaacggtaacgtttcccgaaggggtaccaacggtaccgtaccaacccgtaacgttaaaacccggaccggtaaacctaaaacgtttaaaccggaaacctaacgtaagtttaaactaccgtaggacgtacgtacgaaacctacgtaccgtacgttaccacgtacgttacgacgggtaccgtacgggtacctttacgttaccgttcgttacggtcgtacggtacggttaacgtttaactttaaaccgttaacttaacgtaccttacggttaccctttacccgttttttaacccgaacccgttttccctttaaccggttacccgtttccggttaccgggtacccttaacgggttacccggaccccggtttaccgtacccggtttaccccg

SEQ ID NO: 104835 - DNA, 803 bp, Homo sapiens
  misc_feature: GYAE6OF02F12RY.17.34.D01.1.454.CMB.1.raw
  modified_base (267)..(267): a, c, t, g, unknown or other
  misc_feature (267)..(267): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttagtggtggcagcagctacaggtgtccagtcccaggtccaggttggtgcaatcgtggggctgaggtgaagaccgccgtagggtccctcgggttgacggggtctccgtcgaccgaaggtcctttcgnggacggtccgtaaccctttcgacgacggtaacttagttacgtttacaaggtttgggtcgacgacgggtcctacgtacggactaaccggcctttaggagtgggtacgtagggaacggtactcccgttaccgtagtcggtttacgaacctaaccgtaaccaaacgttcgaacaaccggtaacgtaacgttccgaagggacctaacggacctccaaaccgtacgtaaaccccggacgtaaaccaaacgttaaccgaaactaaccgtaaagttactagtacggacgtcgtaagaaccgacgtaccgttaagtacctagtaccgtaacggaccgggaacgtaacccgggttacgtttacccgttaacgtttcccgttagggttaccgtacggggttaaacgttaaacggtttactttaaaccgttaattaacccggtatccggtttaacctttacccgttttaaccctacccgtttcccgttagttacccgttacggtacggttaaccccgtagggttaccccggtaacccggttccccgg

SEQ ID NO: 104836 - DNA, 856 bp, Homo sapiens
  misc_feature: GYAE6OF02GCO3N.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggtcttcgtggacggcaccttcagcgacttattagtttacaagtttgggtcgcggtacgggcccttcggtacggaacctaagggtccctttaggaggttagggaagtaggggaaacggtagttccggtacccctagttccggtttagaacctaacccgaaccgaaaaccgttaccggactaaaccgaaaggttaaaccgtttacccggaaggggacctaacggtaacccttacccaaacccaacggttaaaccccggaccgggtaaaacctaaaaacgttaaaaccgaaaccgaactaaacgtttaaactacgtacgggtaagtaccgttaagaaaccgtacgtaccgttagttaccaacgttaccgtaggtaacggtaccggaccgggttacttaccgtttaaccgtttcgttacgggtagaacgggtaaggtaaacggtttaaacttaaccgttaacgtaacctaccgtttaccgggttaccctttttaacccgttttttaaccccgttaacccccttttacccggtttaaccgttacccggttttaccggtttacccggggttacccgttaaccgggttacccccggggttaacccccgtttaacccccggg

SEQ ID NO: 104837 - DNA, 618 bp, Homo sapiens
  misc_feature: GYAE6OF02G74VM.17.34.D01.1.454.CMB.1.raw
  modified_base (441)..(441): a, c, t, g, unknown or other
  misc_feature (441)..(441): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgagacgccgtgggtcctcggtgagggtctcctgcaggcttcgtggaggcaccttcagcgacttatagtttacaagttgggtgcggacgggtcctcgtggacaaggtccttaggaggtggagtggggagagtcgtccgtatcgtcgacacacaactcgcacagtacgtccgaggcagactcacagtaacccgacgtactaattaacgacactagttaactcgtaggacgtactagacgacnccgtgacgtatcgtacgacggtacgtaccgggtcttaccgttacttcgtcgtacgaggtacgttaacgttaacttactaactacgaccttgttacctttaccgttttacctaccctttccttaccgttccgttcggtacggtcctacgttccgggtacccgtcccgtacccgtcccg

SEQ ID NO: 104838 - DNA, 658 bp, Homo sapiens
  misc_feature: GYAE6OF02H10OP.17.34.D01.1.454.CMB.1.raw
  modified_base (146)..(146): a, c, t, g, unknown or other
  misc_feature (146)..(146): n is a, c, g, or t
  modified_base (162)..(162): a, c, t, g, unknown or other
  misc_feature (162)..(162): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (419)..(419): a, c, t, g, unknown or other
  misc_feature (419)..(419): n is a, c, g, or t
  modified_base (460)..(460): a, c, t, g, unknown or other
  misc_feature (460)..(460): n is a, c, g, or t
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
tcagcgtagactagcacgaccggtgctcgatttagatcgtctgtgttgggtttggggatcacaaaacaaccagattcctcctctaaagaagccccgtgggagcacagctcatcaccatggactggacctggaggttcctctttggnggtggcagcagctacnggtgtccacgtcccaggtccaggttggtgacaatcgtggggactggaggtgaagcgccgtggtcctggtgacgggtctaccgtgacgaggtcttcgtgggagcctacttcgagccgattatgttntagttgggngcggtacggtcctgtaggacgtaacggtccgttaggacggtaggtagtggggaagtcgtaccgttcctagttccgttagactaccgaacctaactcgcaacgagtaagtcgaacggcagtacncactacgtaccggacaataaacgtaaacactaactaagtanacgtagactacagacgtacgtnacgtcagtacgngtacgacgtacgtctacttagttccgagtcgacgtagtaattaacttacgttaacctacgtacgttacgtaaccttttacccttttaaccgtaccctttaccgttcggttaccttacgggtaccggtaccgttacccgggttcccggtaaccccggttaccccg

SEQ ID NO: 104839 - DNA, 734 bp, Homo sapiens
  misc_feature: GYAE6OF02I7J0R.17.34.D01.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
tcagcgtagactagcacgaccggtgctcgatttagatcgtctgtgttgggtttgggggatcacaaaacaaccagattcctctctaaagaagcccctgggagcacagctacgatcaccatggactggacctggagttcctctttgtaggtggcaggcagcttagcggtagtccagtcccaggtccaggttggngacaagtccgnggggctgaaggtcgaagacgtcctgggtcctaggtgcgggtctcctgaccgtaacggcttcgnggacggccttaccttgagaccgtataagtccgtttanaaggttccggtgaccggtccgggtcttcggagacccgtaaagggcctttggaaggtttcgggtacggaacggggtaaggtcttaaccgttccgtaatcggtaggacccacgtaactaaaccgtnaccgtagaacgtcgttccgaaggcaacgctacgaaccctaacgcggttcaacaaagtacgttaaacgacgtttaccggtataacggtgaaaccggtctttaccggaaacgtaacccgttcgttacgtacgagtacgtaacggtacggtaccggtacgttaacgttaccgttccgtacgttacgtacggtacgttacggttacgtaacgttaacgtaaccgtacgtacgttacgttaccgtttaccgttacgttaaccttaccgtcgttacgttacgtccggtaccttaccggttaccgtcgtacccg

SEQ ID NO: 104840 - DNA, 590 bp, Homo sapiens
  misc_feature: GYAE6OF02HH0DK.17.34.D01.1.454.CMB.1.raw
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgccaaggcttcgtggagcaccttcagcgactatagtttcaattggtncgacgggcctctggacaaggccttgngtggatgggaagtntcgtcctatcgttgacacaccaaactacgcacagaacgtcaggcagactcaccataccgngaacaaactaacgaacacaagttaactactagganactagaacagacctgtcatcgagacgacgacggtcttactacgttcgtgtgtacgtaggtacgttaagttaacttaactacgtacttacggtacctttacctttttaaccaccctttccttacgtaccgtttccgtacgggtaccctacgttaccggtaacccgttacccg

SEQ ID NO: 104841 - DNA, 911 bp, Homo sapiens
  misc_feature: GYAE6OF02IV28R.17.34.D01.1.454.CMB.1.raw
tcagcgtagactagcacgaccggtgctcgatttagatcgtctgtgttgggtttgggacaaaacaaccagattcctcctctaaagaagcccctggggagcacagctcatcaccatggactggacctggaggttcctctttgtggtggcagcagctacgaggtcgtccagtcccaggtcccgtagtttcgggtgacgaacttccgtggggcgttggagggtagaaagaccgtccgtcggggttcccttagggtcggtacgggttcctccgtgacgaaacggtcttcgtgggacggcctaccttcgacgcgaacttagttagtttactaaggttggggtcgacggtaccgggtccctcggtggtaaccgaacgggtcctttagggaggtggtaaggttacggggaacggtacttccggtacccgttacgttcggttaacgtacgaaccaaacccgtaaaaccgtaccgaacgtaacgaaacggtaacggtacccggtaacgggacctacgtaaccgtaccaaacccgtaacgtaaaccccggaacggtaaaccttaaaaacggtaaaccgaaccgtaaactaaagttaaactcgtaacggacgtaaccgtacgaaaacgtccggtaaccgtcgttaaccgtacgttaccggtaacgggtaacggtaccggtaccgggtttaccttcgtttaaccgttcgttacgtacggtacggtaaggttaaccgtaacgtttaaaccttaacgttaaccgtacgttaccgttttaccgttttaaccccgttttaacccgtttaacccggttttacccctttacggtttaaccggttttacccgggtaccccgggttacccttaaccgggggtttaaacccccggtacccccgggtttacccggttaccccggtttacccccg

SEQ ID NO: 104842 - DNA, 813 bp, Homo sapiens
  misc_feature: GYAE6OF02IM8IT.17.34.D01.1.454.CMB.1.raw
  modified_base (267)..(267): a, c, t, g, unknown or other
  misc_feature (267)..(267): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctccgtgcaaggtcttcgtgggaggccaccgttnaggcgaactatagtttcaagttggggtgcggacgggtcctcgtgggaaccaacggtccttaggaggtggacgtaggggaagtcgtccggtacccttagttccggttagaaccaaccgaaacccgtaaaacgtaccggcaaacgaaggtaacgttacccgagggacaacgacttcaaaccgacgtaaacccggacggtaaactaaaacgttaaaccgaactaacgtaaacgtttaacgtaccgtaggtaacgacgttacggaaaccgtacggtacccttaggtacctaacgttcgttaacggaacgtaaccggtaccgggtcctttaacgtaccctttacgtacggttacggtaccgggtaaacgggtaaggtttaaaaccttaaccgttaaaccgttaaaccgtaccgtttaacccgttacccggttttaaccccttttttaacccgtaaccccgttttacccgtttaacggttaccgttttccgggtacccggggttaacccttaccgggtttaaccccgggtaaccccccggttttaaccccgg

SEQ ID NO: 104843 - DNA, 778 bp, Homo sapiens
  misc_feature: GYAE6OF02FXLTB.17.34.D01.1.454.CMB.1.raw
  modified_base (162)..(162): a, c, t, g, unknown or other
  misc_feature (162)..(162): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacgaggtntccacgtcccaggtccagttggtgcaatcgtgggctggaggtgaagacgccgtggtcctgggtgacgggtcctccgtgacaggcttcgtggagtcaccttcagccgactatacgtttcaagttgggtgcggacggcctctaggacgaacggccgttggaggtggagtaggggaaggtactccggtccctagttcgtagaccacaacccgaaactaccgacacgaagtacggtaccagggaccagtaccacaaccgaacgtaaccggaccggaaacctaaaacgtttaaccgaacctaaacgtaacgtttaacgtaccgttagggaccgtacgtacgaaaccgtaacggtacccgttgtaccgtaacgttccggtaagtaaaccgaaccggtacgggttcctttacgttaaccgtttcgttacgggtccgtaacgggaaacggttaacgttaaacctttaaacgttaacgtaaccgttacgttaccgttaccttttaccccggtttttaaccctaccccgttttacccgtttacccgttaccgtttaccgggttaccggggtacccgttaaccggttaccccggggtaacccccggttcgtaccccggtttaccccg

SEQ ID NO: 104844 - DNA, 761 bp, Homo sapiens
  misc_feature: GYAE6OF02HM86B.17.34.D01.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggacggttcctctttgtggtggcagcagctacaggtgtccagttcccaggtccagttggtgcaatctggggctggaggtgaagacgccgtgggtccttcggngagggtcctccgtgngaaggccttctgggacgccacttgagcgactatagttcaagtttgggtagcggtaccgggcctcggtggaacgaacggtccttggaagtggagtggaagcgtccgttcctagttcgtacgaaccgtaacaccgtaaactacgtacacgaagtacggttccgaacggggcaaggtaccctacgaacccaacggttaaccgcggaaacctaaacgttaaaccgaacctaaacgtaacgtttaacgtacgtaaggtacgtacgtaacgtaactacgtaccgttacggttacctaagttccgttaaggacggaacccgttagggtaccctttaccgtttaaccgtccgtttaacggtccgtacggttaacggtaacgttaaacgttaacttaacgttacgtaaccgttacggttaccctttaccctttttaaccgtacccctttacccgttaaccggtttaccgtttaccggtacggggtttaaccccgttacggttaccccgggtaaccccgttacccgg

SEQ ID NO: 104845 - DNA, 613 bp, Homo sapiens
  misc_feature: GYAE6OF02G5K0H.17.34.D01.1.454.CMB.1.raw
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
tcagcgtagactagcacgaccggtgctcgatttagatcgtctgtgttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtgggcctcagtgaacggtctccgtgacaacggcttctggtattcaccgttttacctcctaatactatacaacgtgggtcgcgccaggccgctaggacaacgacctgaaggtggngtgggagtcgggaccgaaaccctaacgcgttagggctcaacgagtcgtacctttcgaacccagttcccncgggtacacggtaccttacagttcaccaacgacctccacaaataaaccacacgaccttacagttggattaggacggtancccgtanacactccgtacgaccgacacggtcctattaaccgttagtcggtagacgttagaccgttcccgaagggtaccttacgggtacacggaccccgttaacgggcgtaccggccggtttaccgtacgttcgtccgggg

SEQ ID NO: 104846 - DNA, 854 bp, Homo sapiens
  misc_feature: GYAE6OF02GRIR7.17.34.D01.1.454.CMB.1.raw
tcagcgtagactagcacgaccggtgctcgatttagatcgtctgtggttggggtttggggatcacaaaacaaccagattcctcctctaaagaagcccctgggagcacacgctcatcaccatggactggacctggaggttcctcttgtggtggcagctagctacaggtgtccacgtcccaggtccagttggtgcaatctggggctgagtgagacgccgtggtctcggtgagggtcctcgtgcgaaggcttacgtggacgcgtaccttcgagcgactatacgttccaagttcgggtcgccggtacgggtccttaccgtcggaccgaaacggtccttaggagtacgggacgttaggggaacggtacggtcccggttacccttaacgtccggttacgtaacgtaacccgtaacccgtaaaaccgttaccggaccctaaacgtaacggttaaaaccggtttcccgaacgggggtccaaccgggtaaccttacccgaaccgtaaacggtaaaccccggacggggtaaaccctaaaaagtttaaaacccggaaacccgtaaaccgtaaacggtttaaaacgttacccgtaagggtaacgtacgttaaccggtaaaccgaccggtaaccgtaccggttaccgtaacgttccgttaacggaacgggtaacggtacccggggttaccttaccgtttaaccgtttcgttacgtacgggtacggtaacggtaacgttaaagttaaccgtaaacttaacgaccgtttacggtaccttttacccgtttttaacctaaccccgttcccgtttaccgtaccgttaccggtcgggttacccctacgttacggggtaaccccccgttaaccgg

SEQ ID NO: 104847 - DNA, 746 bp, Homo sapiens
  misc_feature: GYAE6OF02GSPCL.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctccgtgacgaaggtcttacgtggaggctaccttcagcgactattacgtttcaagttgggtgcggacgggtcctgtcggacaaggtccttggagtggagtagggagactccgtacctagtcgttgacacaaccaactacgcaacgagtaacgtccgaggacagtactaccaaccaacgtaaccgacggaactaaaacgtaacgaactaacgtaagttaactcgtaggacgtactaagaaaccgtacgtaccgtacgtaccgtacgtaccgtagggaacggtacccgtaacgggttccctttacgttacccgtttcgttacggtacggtacggtaagggttaaacgttaaactttaaaccgtaaacgttaacccgtaacgtttaccgtacctttttaccccttttaaacccgtaccccgtttacccgtttacgttaacccgttttccggaacggggttaccccttaccgggttaaccccgggttaacccccggtaccgttaaccccggttaccccg

SEQ ID NO: 104848 - DNA, 799 bp, Homo sapiens
  misc_feature: GYAE6OF02IOHY1.17.34.D01.1.454.CMB.1.raw
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacgaggtcgtccacgtcccaggtccagttggtgctaatcgtgggctgaggtgaagacgccgtgggtcctcgggtgacgggttcctccgtgacgaaggtcttacgtgggacgcctaccgttcagaccgtaactagtttaacgttacgtaagttgggtacgcggtaacgggtcctcgtacggacgtaacggtccgttaggacggtaggtaaggtagggaacggtacgtccgttacccgttaagttcggttacgaaccaaccaaaccgtaaaaccgtacgaccgtaacgaacggtaaccgttaccggaacggacgtaacgtacgtaacccaaccgtaaacgtaacccggaacgtaaacgtaaaacttaaacccgaaactaaacgtaaagttaaacgtaccgtaggaacgtacgtaacggaacctaacgtccgttagtacctacgttaccgtaagaacgggtaacgtaccggttaccgtttacttaaccgttcgtacgtacgtacggtaacggttaacttaaacgttaacgttaacctaacgtacgttacttacccgttttaaccctttaacctacccgttaccgttaacgttaccgtttacggtccggttaaccgtaacggtaccccggtaaccccgttaaccg

SEQ ID NO: 104849 - DNA, 778 bp, Homo sapiens
  misc_feature: GYAE6OF02IUPIS.17.34.D01.1.454.CMB.1.raw
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaagtcgtggggctggaggtgaaaggcgcgttgggtcctcgggtggacgggttctccgtgacgaaggtccgttgtgggaggcctaccttcgagtcgaacttatacgttcaagttggngcggacggctcgnggaacaggtccgttgagtggagtggagtactcgtacctagtcgttacgaacaccgtaacctaaacgtaccgacctaaacgaacggttaaccggttacccggaacgggtaccaacggtaccgtaaccgaaccccgtaaacggttaacccggacggtaaaaccctaaacgttaaaacggaacctaacgttaaaacggttaactacggtagggtaaacgtaccgttaacgaaaccgtacgtacccgttacggtacctacgtacggtaacggaacggtaaccgtacggtaccctttagttacccgttgtacggtacgaccgggtaagtaacggttaaacgtttaacgtaactaacccgttcgttaacgttcctttaaccgttttacccgtaacccgtttaccgttacgttacccgttacggtcccgggttaacccgtacggttacccgggttaacccccgttaccg

SEQ ID NO: 104850 - DNA, 708 bp, Homo sapiens
  misc_feature: GYAE6OF02HV3YK.17.34.D01.1.454.CMB.1.raw
  modified_base (259)..(259): a, c, t, g, unknown or other
  misc_feature (259)..(259): n is a, c, g, or t
  modified_base (415)..(415): a, c, t, g, unknown or other
  misc_feature (415)..(415): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggcttctgggaggcaccttnagcgactatagtttcaattgggtgcgacgggtcctctaggacaacggccttgagtaggagtgggaagatcgttccctatcgttgacacaaccaaacgtacgcacaaggaagttcccgagggacaacggaccttacgaaccctaattaaaccccggngggaaacctaaaaacgtttaaacgaaaccaacgttaaaggttaaacgtacgttagggaacgacgttacgaaacgtacgtacctacggttccaacgttccgtagaacggaacaccggggtaccttacgtacctttcgtacgttacgacgtagggaaacgttaaacgttaacgtaacgtaaacgttactacggttacctttacccgttttttactaaccccctttacccgtttacgttaaccctttcgggtaccgggttacccgtaggttacccggaaccccggtttaaccccgg

SEQ ID NO: 104851 - DNA, 667 bp, Homo sapiens
  misc_feature: GYAE6OF02GXW0J.17.34.D01.1.454.CMB.1.raw
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (575)..(575): a, c, t, g, unknown or other
  misc_feature (575)..(575): n is a, c, g, or t
  modified_base (615)..(615): a, c, t, g, unknown or other
  misc_feature (615)..(615): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagtccttgtattttccggtatttgcctaggaaaaccagccctacccgacgttaaaccggacaaccgtcgcccggaccaacatacgccttcctcccgtcccccttcgcacgtaacaccaagtacagaatacttaacctgttccatcgactacgtccttcggcctcgtcgttagggtcactccacctcgcccgtaattacgtggacacggtaccgtggtccgtcggcgngcggtctttcaccgtcttactcgtacttntgtcacgctacgttcgctacttcgacgtactacccaccgtacgacacttccgcccttacgaactacgtccgaaacccttaccttacgaacgtacggtaccttaaggaaccgtaaaccctcccgtaccccaacctaaacgaccgactaacgaacgtccgtacgccgtcaccgngtacgtcgtcgctacgtcgttaccggtaccttcccgttanaccctttcccgtaccgtcctacgttccgtaacgtaccttacgtcgtacccgg

SEQ ID NO: 104852 - DNA, 697 bp, Homo sapiens
  misc_feature: GYAE6OF02FSF9R.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcgggtgagggtctcctgcaaggcttcgtggattcacgtttacctcctatagtatcaaagtgggtcgcgccaggccgtcgtggacaacggacctggaggtggactggggagtgggaccgaaaccctacgacgttgggtataccgacgtagttcgtcttaccgacccctacgttcccgtaccgggaactaacggtaccttaacccagttaccgaaccctaaccgaaacttccctaccctaaactaaaaccaaccgaacgtacccttaaacacgtacgggtacggttagacggtacggaccttacggaactacgtctagaaccggacaccggtacccgttctaagtttccgtaggttacgacgaacgtaccgtacccgacggtaccgttccgggtacgtaacggccccgtacggaccgtacggtccggtcccgtttacggtaccgtttccgggtcgggggtacccgagggggtaccgg

SEQ ID NO: 104853 - DNA, 725 bp, Homo sapiens
  misc_feature: GYAE6OF02HQQFX.17.34.D01.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtggaggcaccttcagcgtaactattagtttacaagttgggtnacggacggtcctgtaggacaggtccttaggagtggagtggaaggtntcgtacctagtcgttagaccacaaccaaacgtccgacacgagtaacgtccgaagggaccaggacctaccaaccaacgtaacccgacgtaaaccaaagttaaccgaaacctaacgtaatttaacncgtaacggngtactaagaaccgtagtcccttagtacacttcgtaacggacggtaaccgtccgggttaacttccgtttaacgttcgtaggtcggtacgtaaggttaacgttaactttaacgaaccgttaccgtacttaccggttcccttttttaaccccgttttaccctaacccgttttcccggttaactttaaccccggtttccgggtttaccgggtaaccccgttaacccggttcccgggggtaaaaccccccccgtttcccgg

SEQ ID NO: 104854 - DNA, 902 bp, Homo sapiens
  misc_feature: GYAE6OF02HVXO1.17.34.D01.1.454.CMB.1.raw
  modified_base (729)..(729): a, c, t, g, unknown or other
  misc_feature (729)..(729): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctgggaggttcctctttgtggtggcagcagctacaggtcgtccacgtcccaggtccgagtttgggtcgcaagtcgtgggggctggtacggtgaaggacgccgttcggggtcccgtagggtgtaacggggttcctccgtggacgtaacggggtcttcgtagggacggacctaccgtttacgacggaccgtaacgttaacgttaacgttttacgtaaagtttcgggggtacggtacggacccgggggttccttacggttacgggaaaccgtaaaccgggtccgttttagggaggttaccgggtaggtacggggtaaaacgggtccgtttaccgggttacccccttaaggttccgggtttacggaaacccttaaacccgaaaacccgttaaaaccggtaacccgtccggaaaagaaccgggttaaaccggttcccgggaacggggtaacctaacgggtaaccccgtacgaaaccctaaacgggttaacccgacgggtaaaactaaaaccgtaaacgaacctaacggttaagttaagtaccgagggttaacgcgttaacgaacgtacgaccggttagtacctaagtccgtaaggacggtaaaccgngggtttacccttaaccgtcgttacgtcgggacttagggaaacggtactttaaacgtttaccaacgtaaccgtcggttaaccgtttcccttaaaccttttcccaacccctttaccgttacttacgggttaccgcgggttacccttaacggtttcccgggaacccgtttacccgg

SEQ ID NO: 104855 - DNA, 786 bp, Homo sapiens
  misc_feature: GYAE6OF02JXFK1.17.34.D01.1.454.CMB.1.raw
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctgaggtgaagacgccgtgggtctcggtgagggtctcctgcaggcttcgtggagcaccttnagcgactatagttcaagttgggtgcgacggtcctntggacaaggtccttgagtggagtgggaagatcgtcctagtcgttgacactaaccaaacgtacgcacagaacgttccgagggtcagacctacaccgaacgtaaccgcggaaactaaaacgttaaccgaaactaacgtaacgttaaacgtcgttaggaacgtacgtaagaaaccgtacgtaccgttcggtaactacgttacgtacggaaccggtaaccggtaaccggggtcccttttaaccggttaccgtttaccgttacggtacgggtaaccggttaacgggaaacgttttaaaccgtttacgtaaacgtttaacccgtaacggttttaccggttacccccgtttttacctttttttaaacccccggtacccctttttaacccccggttttaaccgggtttttaaccccttttacggggttaacccgggggtttacccccgtttaaacggggttaccccccgggggtttacccccccggttttaaaaccccggg

SEQ ID NO: 104856 - DNA, 718 bp, Homo sapiens
  misc_feature: GYAE6OF02F6R3P.17.34.D01.1.454.CMB.1.raw
tcagcgtagactagcacgaccggtgctcgatttagatcgtctgtgttgggtttggggacaaaacaaccagattcctcctctaaagaagcccctgggagcgacagctcatcaccatggactggacctggaggttcctctttgtggtggcagcagctacaggtgtccagtcccaggtccagttggtgcaatctggggctgaggtagaagacgccgtgggtcctcgggtgacgggtctccgtgcaaggtcttcgtggaggctaccgttcagcgacttatagtttcaagttgggtgcggacgggcctcgtggacgtaaggtcccttaggaggtgggaattggggggaaaggtacgttccggttacccctagttcggttacgaaccaaccaacctaaacgtaccgaccaacgtaaggtaaacgtttcccggaaggggcctaacggaccttaccaaacccgtaaacgtaaaccccggtacgggaaacctaaaaacgttaaaccgaaacctaacgtaaaggtttaactacgttaggacgtacgtacgaacacggtcctagtctagtcgtaggacggtacgacggtcttacttcttagtgcgtcgaaggtaacttaacttagaactaactctacgttctttacccgttttaaccgaccctttcccgtagttaccgttacggtcgggtaccctacggttacccggaccccggttccaccgtttcccg

SEQ ID NO: 104857 - DNA, 659 bp, Homo sapiens
  misc_feature: GYAE6OF02J01OF.17.34.D01.1.454.CMB.1.raw
  modified_base (600)..(600): a, c, t, g, unknown or other
  misc_feature (600)..(600): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtcccagtcccaggtccaggtggtgcaatcgtggggactggaggtgaagacgcctggggtcctcgggtagagggtcctcctgcaaggtcttcgtggaggcctaccgttcagcgactagtagtttcgaattgggtgtcgacggtcctcgttaggaactaaggtccgttaggacgtggagtacggggaaggtacgtcgttcccgtagtcgttcgacgtaacaaccgtaaactacggacacgtaacgtaacgttccgaggcacgtactccgaaaccacgtaaaccggaccggtaactaaaagttaaaccgaactaacgtaaacgttaaacgtacgttaggacgtacgtacgaaccgagcccgttacgtacacgttcctaaggacgaacgtaccgggtacttcgtacgtttactcggtacgaggtactaatactaataactntgtacttctttaccacttcttactgttcgacggtacctagtcccggtaccgtcctaccg

SEQ ID NO: 104858 - DNA, 572 bp, Homo sapiens
  misc_feature: GYAE6OF02IPOIW.17.34.D01.1.454.CMB.1.raw
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
tcagcgtagactagcacgaccggtgctcgatttagatcgtctgtgttggggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctggtgagggtctccgtgcaggtctcgtggagcaccttgagcgactatagtttcaagttgggtgcgacgggcctgtggacaagggccttggagtggagtgggaaggntcgtccctagtcgtgacgacaccaaacgtcgacacagtacgtccgaggcagactcaccataccgcgaacaactacgaacacaagtatctaggncgtagaacncgctagtcactntacgagacgtacgggtcttacgtacttcgtggtcgacgaagtacgttaactacttaatactcgtacgtctttaccctttacacccttccgtagtaccgttcgtcggacctaggtacccggaccctccgg

SEQ ID NO: 104859 - DNA, 754 bp, Homo sapiens
  misc_feature: GYAE6OF02J1IQI.17.34.D01.1.454.CMB.1.raw
  modified_base (218)..(218): a, c, t, g, unknown or other
  misc_feature (218)..(218): n is a, c, g, or t
  modified_base (341)..(341): a, c, t, g, unknown or other
  misc_feature (341)..(341): n is a, c, g, or t
tcagcgtagactagcacgaccggtgctcgatttagatcgtctgtgttgggtttggggagtcacaaaacaaccagattcctcctctaaagaagcccctgggagcacagctcatcaccatggactggacctggaggttcctctttggtggtggcagcagctacaggtcgtccagtcccaggtcctaggttggtgcaatcgtgggctgaggtgaagcgccngggtcctacggtgacgggtctccgtgacgtaaggtcttcgtggggagctaaccttgagtcgacttatacgttctaagttgggtgtccgacgggtcctcgtggtaacgaacggccttagtaggnggtaacgtggggaaggtacttccggtacccgttaagtcgggttacggaactaaccgaacccgtaaacgtaccgcgaaacgtacggtaacgttccgacggggtacctaggtaaccctaccgtaaacccgtacgtaaaccccggtacgggtaaaccctaaaacgttaaaccgaaacctaacggtaaacgtttaaaccgtacgttacgggaacggtacgtacgtaacgtagtaccgtacgtacgtaatccggtaggacggaaccgtacgggtacttacgttaccgtgtacgtgacgacggtagtaacgtactactacctagtaccgtacctttacctttaacacccgtttacccgttacgtaacccgttttcggacccgggttaacctacgggttacccggtaacccgttacccgg

SEQ ID NO: 104860 - DNA, 611 bp, Homo sapiens
  misc_feature: GYAE6OF02FRPHQ.17.34.D01.1.454.CMB.1.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (413)..(413): a, c, t, g, unknown or other
  misc_feature (413)..(413): n is a, c, g, or t
  modified_base (502)..(502): a, c, t, g, unknown or other
  misc_feature (502)..(502): n is a, c, g, or t
  modified_base (548)..(548): a, c, t, g, unknown or other
  misc_feature (548)..(548): n is a, c, g, or t
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacaggtgtccagtcccaggtccagtttggtgcaatcgtgggctgaggtgaagcgccgtggtcctcgggtgagggtctcctgcgaaggtcttcgtgggaggctacccttnagaccgactatagtttnaagtttgggngcgacggcctgtaggacgaaggtccttggagtcggagtgggaagcgttcgtcctagtcgtagacctaccaacctaactacgcacgagtacgtcgaggcacgtctacacgtaacgtaacccgnggaacctaaaagtacccgaatacgtaagtaatcgtagacacgtacgaactcgacctgtactgtcgtagagaccgcgtacttctacttgngtgcgtagtactaagtactaactacagttctactttccgtttaacnccgttcccttagttccgttacggtcggtaccaccggttaccggtacccctcgtaccgtccccg

SEQ ID NO: 104861 - DNA, 632 bp, Homo sapiens
  misc_feature: GYAE6OF02JBCKU.17.34.D01.1.454.CMB.1.raw
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatggggaagatcgtcctatcgtgacgacaccaactacgcacagaacgttcaggcagactnaaccataaccgcggaacaaattaacgaacaactagttaaactcgtaggaagtctacggaaacngtaccctgtacattctacgaaggtaccgaccgggtcttaccttaaccgtttcttaggtcggacgtaaggtacgttaaattacgttaataactacgttcgtaccttttaccgtttttaacctacccctttacccgtttagtacccgtttccggttacggggtaccctaaggttacccggtaaccccggtttccccg

SEQ ID NO: 104862 - DNA, 717 bp, Homo sapiens
  misc_feature: GYAE6OF02I7O96.17.34.D01.1.454.CMB.1.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (406)..(406): a, c, t, g, unknown or other
  misc_feature (406)..(406): n is a, c, g, or t
tcagcgtagactagcacgaccggtgctcgatttagatcgtctgtgttgggtttggggatcacaaaacaaccagattcctcctctaaagaacgcccctgggagcacagctcatcaccatggactggacctggacgttcctctttgtggtggacaggcagctacgaggtcgtaccacgttcccaggtcctaggttggngacaagtcgtgggtctggacggtgaaagcgccgtgggtcctggtaggacggtcctccgtagacgtaggtccttgnggacgtcaccgttnacggctactagttagttacgagttcgggacncggacggtcctgtacggacgaggtcctaggcgtaggtgtagggagcgtcgtacctagtcgtacgacacaacgtacacgtcaacgtagtancgtaggcaacgtacaccaacgtaacgaccggtacgtaactaaacgtaacgaacgtactaacgtacgtacgtagtactacgacgtaacgtctaccgttatacgtactcgtaacgacggtaccgtacgttcttaaccgtacgttccgttaggtacctagggttaaacgagtttaaaccgtagtaaccgtacggttaaccttaacggtttccccgttttaaaccgttaccgtacccgtttacccgttaggttacccggttaccggttacccgggttaacccgtaaccgggtttaccccgtaaccccgggttccc

SEQ ID NO: 104863 - DNA, 685 bp, Homo sapiens
  misc_feature: GYAE6OF02JBNG9.17.34.D01.1.454.CMB.1.raw
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (365)..(365): a, c, t, g, unknown or other
  misc_feature (365)..(365): n is a, c, g, or t
tcagcgtagactagcacgaccggtgctcgatttagatcgtctgtgttggggtttggggatcacaaaacaaccagattcctcctctaaagaagcccctgggagcacagctcatcaccatggactggacctggaggttccttctttgtggtggcagcagctacaggtgtccgagtcccaggtccaggttggngcaatcgngggctgaggtgaagacgcgtggtccgtcggtgaggtcnccgtgacgaagcttcgnggacgctacgtcagcgtactatagttacagttgggtcgaccggacgggtcctgtacggtaacgtaacggtccttggacggtggagtgggaacgtctccgtacctagtcgtanaccaacgtaaccaacgtacgacctagtaacgtacgtaccggagtaccagtacctaccgaaccgaacgtacccggacgtaaactaaactaaccgtaacaacgtaggtaactcggtaagaccgagtaacgaacgacgttcgtactacgacttagaccggagaccgtccggtacttccgtacgtcgtacgaccggaagtaacggtacttaaacgtactactagtaccgtcggttaccctttaccgttaaacctccgttcccgtttaagttacccgtttcgggttaccgtaacccgtacggttaacccccggaccggttacccg

SEQ ID NO: 104864 - DNA, 697 bp, Homo sapiens
  misc_feature: GYAE6OF02FQBR7.17.34.D01.1.454.CMB.1.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (374)..(374): a, c, t, g, unknown or other
  misc_feature (374)..(374): n is a, c, g, or t
  modified_base (440)..(440): a, c, t, g, unknown or other
  misc_feature (440)..(440): n is a, c, g, or t
tcagcgtagactagcacgaccggtgctcgatttagatcgtctgtgttgggtttgggggtacaaaacaaccagattcctcctctaaagaagccctgggagcacagctcatcaccatggactgacctggaggttctctttgtggtggcagctagctacaggtgtccagtccaggtcagttggtgcaatctgggctggaggtgaagacgctgggtcctcgggtgggggtcctctgcaacggcttcngggngcaccttcagcgactatagttcaagttgggtgcggacgggcctcgtggaccgaaggtccttgaggttggaagttggggaaggatcgtcctagtcttgacacgaccaaatacgcactagaacgttccngggcagacctcacctaactaacggcggtaacaaattaaccgaacaactaacgtaatacttagggancgttacaaacgacggccacggttacattacgtgacggtacaccggggtcttaccgttaacgtttcctaggtggaccggttaagggtaacggttaaacttaacggtaaacttaaaccgtaaccggtacgttaccgtttaccgtttttaaccccgttaaccgttccccggtttaaacgtacccggtttcgtttaccggggtccttaacgggttacccggttaacccggggtttaccccctaccggttacccttaccccg

SEQ ID NO: 104865 - DNA, 640 bp, Homo sapiens
  misc_feature: GYAE6OF02GA25S.17.34.D01.1.454.CMB.1.raw
  modified_base (258)..(258): a, c, t, g, unknown or other
  misc_feature (258)..(258): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
tcagcgtagactagcacgaccggtgctcgatttagatcgtctgtgttgggtttgggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaacgacgcctgggtcctcggtgacgggtctcctgcaggcttcgtggagcaccttnagccacttatagtttcaatttgggtgacgacgggcctcgtggacaaggtccttgagtggagttaggggagtagtccggtcctagtcgttgtaacacaaccaaacgtacgaccacagtaacgtcgaggcacgactcaccgataaccgacgaacaattaacgaactanaagttaanctaggatcgtagaacncgacctgtacntcgtagacggtcgacggtcttacgttacttcgtagtcggaacgtaggtagttaaacttaacgtaactaactacgttacgttacctttaccttttaacctacccgtttacccgttcgttaaccctttcgggtacggtaccctacggttacccggaaccccggttcccgtaaccgttccccgg

SEQ ID NO: 104866 - DNA, 730 bp, Homo sapiens
  misc_feature: GYAE6OF02H0BQ4.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgctgggtcctggtgagggtctcctgcaaggcttcgtggaggcaccttcagcgactattagttctaagttgggtgcgacgggcctcgtaggactaggcttggagtggagtgggaagtctccgtcctagtcgttagaccgaaccaaccgtaaacgtaccgaccaacgtaacggtaacgttcccggaagggtacaaccggtacctaaccaacccgaacgtaaacccggacgtaaacctaaaacgttaaaccgaaaccgtaactaaacgtttaacgtacgtacggtacgtacgtaacgaacgtaacgtccgttagtaccgtacgttacgtacggaccggtaaccggaccgggttaccttaccgttaccgttacgtggtacggtacggtaaggtaacgttaaacgttaaccgtaataaccgtacgtttaccggtccttttaacccttttacctaccccttacccgttacggttaccttaccggtaccgggtaccctacggttacccggtaccccggttaccccg

SEQ ID NO: 104867 - DNA, 787 bp, Homo sapiens
  misc_feature: GYAE6OF02IKVQJ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccaggttggtgcaatcgtggggctgaggtgaagcgccgtgggtcctcggtgagggtctccgtgacgaacggcttcgtgggaggcctaccgttcgaggccgacttattagtttacaagttgggtggcggtaccgggtcctcgtggaacgacggtccgtttggacggttagggaggtacggggaagggtacttccggttccctaagttcggttacggaacccgaaccaaaccgtaaaactaccggtaccaacgtaacgggtaaaccggttcccgaacggggtaccaacggtaacctaccgaaccctaaacggtaaacccggaccggtaaacgttaaaacgttaaaccgaaacctaaacgtaacgtttaagtaccgtagggtaacgtacgtaacggaacctacggtacctagtacctacgtacgtacggaacggtaccgtagggttaccttaccttacgtttcggtagtacgggtacgtaaagggtaacttaaactttaaccgtaacttacgtacttccggttaccctttaacccgttttacctcccctttaccgtttgtaccgttccggtaccgggttacccgtacgttacccgggtaccccggttacccg

SEQ ID NO: 104868 - DNA, 837 bp, Homo sapiens
  misc_feature: GYAE6OF02HEKXA.17.34.D01.1.454.CMB.1.raw
  modified_base (141)..(141): a, c, t, g, unknown or other
  misc_feature (141)..(141): n is a, c, g, or t
  modified_base (189)..(189): a, c, t, g, unknown or other
  misc_feature (189)..(189): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
tcagcgtagactagcacgaccggtgctcgatttagatcgtctgtgttgggtttggggacaaaacaccagattcctcctctaaagaagcccctgggagcacagctcatcaccatggactggacctggacgttcctctttggnggtggcagcagctacgaggtgtccagtccccgaggtccaggtttcggngacaagttcggtggggctggaggtgaacgacgtccgttacgggtccgtagggtgacgggttccttccgngacgtacggtctttacggnggaacgtcctaccgttacgacggccgtaaccttagttacgttcgtaagttcggggtcgaccggtacccgggtcctacgtacgggaacgtaacgggtccgttagggtacggtgggtacggtagggggtaacggtacgttaccgggttccccgttaggttccggtagtaaccgaacccgtaacctaaccgtacgtacaacgtaacgttaaaccgtcgacggttaccgaacgtaccgttcaaccggtactaaaccggacgaaacttaaacgtaacgtaccaacgtacgttaagtcggtaacggtacgtacgtacgtaacgaccttacgtcgttacgtactaccggtagggtaaccgtccgtaccggttaccgtttacgtacttcggttacgttacgggaggttaaccggtaagtttaaaccctttaacgtaacgttaccgttaccgttaccgtttaccgttttaccccgtttccgtacccgtttaccgttacccggtaacgtttccggtacccgggtaccttacccgggttaccccgtaacccgggttccctacccgttcccg

SEQ ID NO: 104869 - DNA, 996 bp, Homo sapiens
  misc_feature: GYAE6OF02HTI9R.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgagggtgaacggacgccgtgggtccttcgggtaggacggggttcctccgtggacgaacgggtcctttcgtagggacggtcctaaccgtttcacggtccggtaacctttaagttaacggttttaccgtaaagtttgggggttacggaccgggtaacccgggggtcccttacggttacgggaaccgtaaccgggtaccccgttttaggtaacgggttggggtaaggttgggggaaacgggtacgtttacccgggttaccccgttaggtttaccggtttacggaaaccctaacccgtaaaccctaaaaccgttaaccggaccgtaaaccggtaaacggtaaccggttaccccggaaggggtacctaacgggtaaacccttacccgaaacccgtaaaccggtaaacccggaaccgggtaaaaccgtaaacgttaaaccgaaacgtaaaccgtaacgtttaaacgtaccgttagggaacgtaccgttaacggaaaccgtacggtaccgttacgttacccgaacgttaccggtaacggtaaaccgggaccggttaaccgggtttccgttttaaccgttacccgttttacggtaccggtttaccgggtaaccgggttaaacggggttaaactttaaaaccgtttaaccgttaaaccgttaacccgttcctttaaccggttacccttttttaaccccgtttttaacccgtaccccttttacccggtttacggttacccggtttcccggttaaccggggtaccccttaaccgggtttaccccggggtaacccccgtttaccccgg

SEQ ID NO: 104870 - DNA, 788 bp, Homo sapiens
  misc_feature: GYAE6OF02FLHJJ.17.34.D01.1.454.CMB.1.raw
  modified_base (367)..(367): a, c, t, g, unknown or other
  misc_feature (367)..(367): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagcctacaggtgtccagtcccaggtccagttgtgcaatctggggctgaggtgaagcgccgtgggtcctcggtgacgggtctcctgcgaacggtcttcgtggacggcacccttcgagcgactatacgtttcagttgggtcgcggacgggtcctcgtggaccaaggtccctttaggacggttaggagttgggaagtagtccgtcccgttaatcggttanaccgtaacaaaccgaaacctacgactacgaacggaacgttcccgaggggaccaggacctaccacctaactaacccggacggaactaaaacgtttaaccgaaccaacgtacgttaaacgttcctaaggtacgtccgtaacgaaaccgacggtaccgttacgtccgtaacgtacccgttagggaccggtaacccggtaccgggttccgttttaaccgttacgtttaccgtacggttaggtaccggtaaacggggtttaagttaaaacctttaaaccgttaaattaacccgttaccgttaccgttaccttttaacccgtttttaaaccctaccccgtttaccccgtttaaccgttaccgttaccggttaccgggtaccttaaccgggtacccggttaaccccccggtacgtaccccgttacccg

SEQ ID NO: 104871 - DNA, 727 bp, Homo sapiens
  misc_feature: GYAE6OF02IT5SZ.17.34.D01.1.454.CMB.1.raw
  modified_base (472)..(472): a, c, t, g, unknown or other
  misc_feature (472)..(472): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggagttcctctttgtggtggcagcagctacaggtgtccagtcccaggtccagttggtgcaatcgtggggctgaggtgaagacgccgtgggtcctcggtgagggtctcctgcaagggtcttcgtgggaggcctacccttcgacgccgtaacttattacgtttacaaagtttggggtcggacggtaccggggtcccttcgtacgggaaccgtaacgggtcccgtttaggaaggttagggacgtaggggaaacggtacgtcccggttaccctagttccggttacgaccgaaccaaccctaaacgtaccgacaacgtaacggtaacgttaccggaagggaccagtaccnccaaaccctaacgaaaccccggtacgaaactaaacgtaaaccgaacaactaagttaactcgtagtagactagaactactacgttagtcacgtacgtacgacggacgaccggtccttacgttacttcgtcggtagacgtaacgtagttaaacgttactaactacgtaccttacggttacctttacccttttaccgtaccgtttccttacgttccgttccggtaccggtaccctacggtacccggtaccccgtcccg

SEQ ID NO: 104872 - DNA, 699 bp, Homo sapiens
  misc_feature: GYAE6OF02JDFEF.17.34.D01.1.454.CMB.1.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
tcagcgtagactagcacgaccggtgctcgatttagatcgtctgtgttgggtttggggatcacaaaacaaccagattccctcctctaaaagaagccccctgggagcacagctcatcaccatggactggacctggaggttcctctttgtggtggcagcagctacaggtgtccagtcccaggtccagttggtgcaatcgtggggctgaggtgaagaccgccgtgggtcctgggtgagggtcctcctgcgaaggtcttcgnggacgctacccttncgcgtactagttagttctagttgggngcggccggctcgtaggacgaggtccgttggacggtggaggtcggggaagtaccgttccgtaccgtattcggtcgaaccaacctaaccaaacgtccgacaaccgagtaaccggttccgacgggacagacctaccaaccgtaacgaaccggacgaactaaaccgttaacgaaactactaacgttaatcgtaggacgcgtacgaactacgtccttagtcactacgtacggacgtaccgtaccggttacttaccgttactttcgtacggtcggacggtaagtaacgttaactttaaccgtaacttacgtacgttacggtttcccttttaccttttaccctaccctttcccgttagttacccgttcggtcccgggtaccttacccggacccggttaccccgttcccg

SEQ ID NO: 104873 - DNA, 689 bp, Homo sapiens
  misc_feature: GYAE6OF02I512N.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaattcgtggggctggaggtgaagacgccgtgggtcctcgggtgacgggtctcctgcaaggtcttcgtggacggcctaccgttcgagcgaacttagtacgtttactaagttgggtgcggacgggtcctagtacggacaaggtccttggaggttggaggtgggaaggacgttccgtacccttagtcggttacgaacctaccaaacccgaaaaccgtacgaccaactaaggtaaccgttacggacgggtacacggtacctaccaaccaacggtaaccggacgtaactaaacgttaaccgaacaactaacgttaagtcgtaggagtacgtacgaacgtacgtaccgttagtacgtacacgtacggagaacgtacggtcctttactaccttgtcgtacgacggtaacgtattaacgttactaactacgacttacgtcctttaccgtttaccacccgtttacctcgttacgttcggtaccggtacacggttaccggacccgttaccg

SEQ ID NO: 104874 - DNA, 765 bp, Homo sapiens
  misc_feature: GYAE6OF02JR53S.17.34.D01.1.454.CMB.1.raw
  modified_base (186)..(186): a, c, t, g, unknown or other
  misc_feature (186)..(186): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttctctttgtggtggcagcagctacgaggtgtccagtcccaggtccagttggtncaatcgtggggctgaggtgaagcgcctgggtcctggngaggtctcgtgcaaggcttcgnggagcaccttnagcgactatgttcaagttgggtcgcgacgggtcctagtacggaacgtaggtccgttaggacggtggtaggttaggggaagtcgtaccggttccccgtaagttcggttacggaacctaccgtaaccgaaaccgtacggacctaaacggtaacggtaaaccgtttaccggaaggggaccaacgggtaacctacccgtaaccaaacgtaaacccggtaccgaaaacgttaaaccgttaaaccggaaacctaaacgtaacgttaaacgttcgtaagggtacgtaccgttaagaaccgtacgtaccgtagtacctaaagtccgtaagggaccggtaccgtacggtacctttacttacgttaccgttaggacgttacggtaacgggtaaattaaccttaccgttaaacgttaccgaacggttccgttaactttacccttttaacccacccgtttaccgttacgttaccgtttaccgggcggtaaccctacggttacccggtacccggttaacccg

SEQ ID NO: 104875 - DNA, 632 bp, Homo sapiens
  misc_feature: GYAE6OF02FP4KT.17.34.D01.1.454.CMB.1.raw
  modified_base (232)..(232): a, c, t, g, unknown or other
  misc_feature (232)..(232): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (408)..(409): a, c, t, g, unknown or other
  misc_feature (408)..(409): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (518)..(518): a, c, t, g, unknown or other
  misc_feature (518)..(518): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcagtcacgcctcagccttgattttccggatttgcctggaaaaccacgcctacccgcttaaaccgggacaaccgtcgcccggccaacatagccttcncccgtcccccttcgcacgtaacaccgaagtacaggtaactattaacctgtttccccatccgactacgcctttcggcctcgcttaggggtcactcaccctgccccgattacgtgacagtaacccttggtccttcggcgtcggcgggtcttttcacccgtctttancgttatntntcnncagtcnctacttngactaccnacgcatcgtcncacngacnctaccttcacgagtactacaacgccgacctccccgaaccactaaccgactaagtaacgtcccggtaacnccgtcgacccgtatacgttccgttaccggtcgtcgtacgttacgggtttacccgcccgttttacgaccctttcggtaccccgcttacttaccgtacgtacttaccgtacgtccg

SEQ ID NO: 104876 - DNA, 792 bp, Homo sapiens
  misc_feature: GYAE6OF02FMGD3.17.34.D01.1.454.CMB.1.raw
  modified_base (122)..(122): a, c, t, g, unknown or other
  misc_feature (122)..(122): n is a, c, g, or t
  modified_base (384)..(384): a, c, t, g, unknown or other
  misc_feature (384)..(384): n is a, c, g, or t
tcagcgtagactagcacgaccggtgctcgatttagatcgtctgtggttgggtttggggatcacaaaaccaaccagattcctcctctaaacgaagccccgtgggacgcacagcctcatcaccntggactggacctggtacggttcctcgttggtggtcggcacgctagctacgagggtctccacggttcccaaggtcctaggtcggtcgactactcgtggggctgaaggtcgaacgccgtcgtcggttccgtggtacgcggtactccgtgaccacggtccttcgtcggaccgtccaccgttcgaacgtcgaattcttacggtttacgacggtttcgggcgaccggtaccggtcctacgtacggaccgttacgaacgttcgtaggnggtaacggaccgggaagttacttcccggtaccgtagttaccggtcaacccgaaccaacccgtaaacgacccgataaccgtaacggtaccgtaccgacggtaacgacctaccgtaaccaacccgtaccgtaacccggaacgtaacccaaacggtaacctaccgtaacgtagtaacctcggaacgtaccgtacgtaaccgactaccgaccttcgaaccgtcgtaaccgtcgggaaccggaccgtttacggtaaccctacttaccgaacgtttacgaccgtaacgggtaactaaacgtttaacgcccctaaacgttacccgtactacgtttacccgtaccttaaaccccgtcttcccggattaaccgggtcccgtaccgggaccctaccggtacccggtaaccccttccgg

SEQ ID NO: 104877 - DNA, 616 bp, Homo sapiens
  misc_feature: GYAE6OF02IC52R.17.34.D01.1.454.CMB.1.raw
  modified_base (405)..(405): a, c, t, g, unknown or other
  misc_feature (405)..(405): n is a, c, g, or t
  modified_base (469)..(469): a, c, t, g, unknown or other
  misc_feature (469)..(469): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttttgtggtggcagcagctacaggtgtccagtcccaggtccagttggtgcaatctgggctgagtgaagcgcctgggtcctcggtgagggtctcctgcaaggcttcgtgggaggccacttcaggccgactattagtttcaagtttgggtgcggacgggtcctcgtacggactaacggtccttggacggtggagtaggggaagactccgtcctagtcgttagaccacaccaactcgcacagagtccaggacagacacacacgtaccgngaactaaactaacgacaactaattaactacgtaggacgactacgaacagtacctgtacatacgngacgtacgacggtacttcgttactcgtgtcgtagaggtaatattactaataccgtacttcgttacctttaccttttacctccctttacccgttgttacccgtttcggtaccggttacccgacggttacccggtaaccccggtacccg

SEQ ID NO: 104878 - DNA, 846 bp, Homo sapiens
  misc_feature: GYAE6OF02IWYFW.17.34.D01.1.454.CMB.1.raw
tcagcgtagactagcacgaccggtgctcgatttagatcgtctgtgttgggtttggggatcacaaaacaaccagattcctcctctaaagaacgcccctgggagcacagctcatcaccatggactggacctggaggttcctctttggtggtggcagcagctacaggtgttccacgtcccaggtcctaggttggtgcaatcgtggggctgaggtgaacgtacgcctgggtcctcggtggacgggtcctcctgcctaagggtccttacgtagggacgtccgtaaccctttcgacgtccggtaactttaacttacggttttaccaaggtttacgggggtacggtccggaccggggtaccccttgtaacggtacgtaaaccggggtcccttaggggtagtacgggtaggtacgggtaacggtacttaccgtaccccgtaggtttccgtacggtaaaccgacctaacccgtaaaacgtaccgtaccgtaaacgtaaggtaacccggtttacgaccgggggtaactaacgtaacctttaaccggacctaaaaccggtaaccccggaccgttaaaacgaaaaccgttaaacccgtaaacgtaacctaaagttaattcgtacgggaagtaccgtacgaaccgtgtaccgttacgtacgtaacttacggttacgacggaacgtaccgggtaccttacctttaactcgttacgtacgacggttaacggtaaagttaaagttactaacgtactaaccgttacgttcccgtttaaccttttacgtaacccctttccgtttaacgtacccgtttaccgggttaccggtaaccccgtaggtaccccgttaccggtacccccg

SEQ ID NO: 104879 - DNA, 754 bp, Homo sapiens
  misc_feature: GYAE6OF02HTLPC.17.34.D01.1.454.CMB.1.raw
  modified_base (204)..(204): a, c, t, g, unknown or other
  misc_feature (204)..(204): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacaggtgtccagtcccaggtccaggttggtgcaatcgtggggctgnggtgaagacgcctgggtcctcggtgagggtctctgacaaggtcttcgtggagccacttcgagccgactatagttcaagttgggtgcgacgggtcctcgtggacaaggccttgacggtggagtagggaaggctcgtacctagtcgttagaacacgaacctaaactaccgacaacgaacggtaacgttcccgaacgggtcaacggtaactccgaaccctaacgtaaacccggacggtaaacgaaaacgttaaaccgaaaccctaaacgtaaaggtttaaactaccgttaacgggaacgtaccttaacggaaacgtaacggtaccgttacgtaactacgttacgacggtaacggtaaccgaccgggttaccttaccgttactttcgtggttaccgtagggtaacggtaaacgttaaacgtttaacgtaacgttaacctagttaccggtaccctttttacccttttaacctacccccgtttacccgtttacggttacctttccgggttaccgggttacccgtaaccggttaccccgggtaccccgttaccccgg

SEQ ID NO: 104880 - DNA, 752 bp, Homo sapiens
  misc_feature: GYAE6OF02JE6VC.17.34.D01.1.454.CMB.1.raw
  modified_base (288)..(288): a, c, t, g, unknown or other
  misc_feature (288)..(288): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttggtggtggcagcagctacaggtgtccagtcccaggtccagttggtgcaatctggggctgacggtgaagacgcctgggtcctcggtgagggtctcctgcaaggcttctggaggcaccttcaggcgactatagtttcaaagttgggtncggacgggtcctcgttcgggacctaagggtccctttaggaggttgggaacgttgggggaaaggtacgttcccgtacccgttagttcggtttacggaacctaaccgaaccctaaaacgttccggacaaccgtaggaaaccgtttcccgaaggggtccaaggtaaccctccgaaaccgtacgtaaacccggacggaaactaaacttaacggaaactacgtaatttaacgtcgttaggacgtactagtaaaccgaggtcccttaggtactacttcgtagacggtacccgtacggggtctttaccttacggttccgtaggtacggtacgtaacgggtaaacttaaacgttaaccgttaactaacctacggtagttaccccgttttaaccttttaacccggacccctttcccgtttacgtaccgttccggtacgggtccctacggttacccgggtaaccccgggttccc

SEQ ID NO: 104881 - DNA, 718 bp, Homo sapiens
  misc_feature: GYAE6OF02IQR1R.17.34.D01.1.454.CMB.1.raw
  modified_base (268)..(268): a, c, t, g, unknown or other
  misc_feature (268)..(268): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (410)..(410): a, c, t, g, unknown or other
  misc_feature (410)..(410): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctggtgacgggtctccgtgcgaaggtcttcgtgggagcctaccttnagcgactatagttcaagttggtancggacggtctcgnggactaggccttgaggtggatgggaagntcgtcctagtcgtgacactaaccaaactcgacaacgtagaacgttccgaaggcacgactacacctaagtaacccggngaacctaaaagtaaccgaactaacgtaagttaacgtacgtaggaacgtacgtaacggaactacggacccttagtaacctagttacgtaacggaaccggaacccggtacggttacctttccgttaacgttcctagggtcggtaacgggtaacggtaaagttaaacctttaacgtaaccttaacgtaccgttacggtaaccctttttacccgttttaaaccgtccccccttttaaccgtttttaaccgttccggtaccggggttacccctaaccggtttaacccgggtaaccccccgttactacccccgg

SEQ ID NO: 104882 - DNA, 641 bp, Homo sapiens
  misc_feature: GYAE6OF02GQG0M.17.34.D01.1.454.CMB.1.raw
  modified_base (441)..(441): a, c, t, g, unknown or other
  misc_feature (441)..(441): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtggaggcaccgttcagcgactattagttcaattgggtgcgacgggcctctggacaaggccttgagtggatgggaggatcgtcctatcgtagacacaccaaactacgcacagaacgttcgaggcagactcaccagtaaccggcgaactaaagtaaccgaacacgtaagttaactacgtaggagactagaaccgngaccttgtactagtactaggacggaacgtacggggtcctttacgttacgttcgtaggtcgacggtaacggtaattaaactttacgtaagttaacctacgttaccgttaccttttaccctttttacctacccttttacccgtttcgttaccgtttccggtccggggtacccctaggttacccgggtacccccggttacccg

SEQ ID NO: 104883 - DNA, 748 bp, Homo sapiens
  misc_feature: GYAE6OF02JFLST.17.34.D01.1.454.CMB.1.raw
  modified_base (167)..(167): a, c, t, g, unknown or other
  misc_feature (167)..(167): n is a, c, g, or t
  modified_base (558)..(558): a, c, t, g, unknown or other
  misc_feature (558)..(558): n is a, c, g, or t
tcagcgtagactagcacgaccggtgctcgatttagatcgtctgtgttgggtttggggatcacaaaacaaccagattcctcctctaaagaacgccccgtggggagcacagctcatcaccatggactggacctggacggttcctctttggtggtggcagcagcgtacgnggtcgtccacgtccccgaggtcctaggttggtcgcgtaatccggtgggggcgttggagggtagaacggccggtccgtcgggtcctgggtagggtcgggttcctcccgtggacgtacggtccgttccggtagggacggcctaccgttcgcgtacgaccgttagttagttacgtaagttgggtcggcggaccggtcctacgtcggaacgtacgggtccgtaggacgtagggtaggtagggaacgtccgttcggtccgttagttccgtacgaacctacggaaaccgttaccgacgaactacgtaagaaccgtcgaacgacgacgtaccgacaccgtaacgacccggacaaacgtaaactaaccggtaactaacgtaacgttactaggtaggtanacgtaacggactaccggtactacgtactaacgtacgtcggtacggaccggttactcgttaccgtcgtcggtactagggtactaaggtactaacgtactaacgtcattccggttaacctttccgtaccgttacctacccgttacgtacttacggggcccgttaaccggtacctaccggggtaccccgtccg

SEQ ID NO: 104884 - DNA, 577 bp, Homo sapiens
  misc_feature: GYAE6OF02FJVSG.17.34.D01.1.454.CMB.1.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
tcagcgtagactagcacgaccggtgctcgatttagatcgtctgtgttggggtttgggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcngggaggcaccttcagcgactatagtttcaattgggtncgacgggctctggacaaggccttgagtggatgggaagntcgtcctatcgtgacacaccaactcgcacagagttcaggcagacncaccanaaccgcggaacaataacgaacactagtaactcgtgagcagaacacgactgtcatcgagtacggacgtcggtcttacgttactttcgtgtcgtacgagtagttaacttactatacgtactacgtctttaccttttaacctccgtttacccgttacgttacgtttcggtacgggtaccctaggttaccggtaccccggtacccg

SEQ ID NO: 104885 - DNA, 706 bp, Homo sapiens
  misc_feature: GYAE6OF02GXEON.17.34.D01.1.454.CMB.1.raw
  modified_base (588)..(588): a, c, t, g, unknown or other
  misc_feature (588)..(588): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggtcttcgtggacggcaccttcagcgtactatagtttacaagttgggtcgcggacgggtcctcgtggaccgaaggtccgttaggacggtgggagtacggggaaggtacgttcgtccctagttcggttacgacaaccgaacctaaaccgtaccgacacgaacggtaacgttacccgagggacaacgactacccgaacctaacggtaaacccggacgggtaaacctaaaacgttaaaccgaaacctaactaacgtttaaataccgtagggacgtactaacgaaacgtacggtccttagtacctagttacgcgaacggaaccacgggtacttccttaccgttacgttcgngtaccggtagtaacgttaattactaactactacgttcgtacctttcccttttaaccaccccgtttccttaggtaccgtttcggcgggttaacctacggtacccggtacccgttacccg

SEQ ID NO: 104886 - DNA, 663 bp, Homo sapiens
  misc_feature: GYAE6OF02FKOXU.17.34.D01.1.454.CMB.1.raw
  modified_base (181)..(181): a, c, t, g, unknown or other
  misc_feature (181)..(181): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (443)..(443): a, c, t, g, unknown or other
  misc_feature (443)..(443): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
tcagcgtagactagcacgaccggtgctcgatttagatcgtctgtgttgggtttggggacaaacaaccagattcctcctctaaagaagcccctgggagcacagctcatcaccatggactggacctggaggttcctctttgtggtggcagcagctacaggtgtccagtcccaggtccagttgngcaatctgggctgagtgagacgcctgggtcctcggtggggtctcngcaggtctnggagcaccgttcacgcgtactatagttcaagtttgggtcgngtacggggcctcgtggacaaggtccttgaggtcgtagtgggaaggatcggttccccagttccgtagaccgtaacacccaaacttaccgacacgaagtaacgttaccgacgggtacacgtaacgcgaaccataaacccgcgtaacaaacttaacgactactagtaacncgtgagctacgtaacncgtctacncgcttacgngacggacgtaacgggtcttaccgtcttacgttacttcgacgtaaggtacgtttaattaaccttaattaacgaaccgttacgtaccgttaccgttttacgtaacccccttccgtttaaccgtacccgtttcccggtagggtccgttaaccgtaccggtaccccggtacccgtcccggttccttacccg

SEQ ID NO: 104887 - DNA, 910 bp, Homo sapiens
  misc_feature: GYAE6OF02HPW1B.17.34.D01.1.454.CMB.1.raw
  modified_base (143)..(143): a, c, t, g, unknown or other
  misc_feature (143)..(143): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgnggtggcagcagctacaggtgtccagtcccaggtccaggttggtcgcaacgtcgtggggctggaaggtagaaacgacgtccgtgggtcccttcgggtggacgggttcctccgtaggactaaaggtccttcgtaggacggcctaccgttcaggaccgtacttaagtagtttacgaaacgtttcggggtacgaccggtaccgggaccttcgtacggaaccgaaacggtcccttttaggaaggttgggaacgtaggggtaaacgtacgttccggtaccccgttaagttccggttacggaaccctaaaccgaaaaccccgtaaaaaccgttaaccggaccgtaaaccgtaaacggtaaaccggtttaccgaacggggtaccaaacggtaccttacccgaaacctaaacgttaaacccggaacggtaaacctaaaaacgttaaaccgaaaccgtaacgtaaacgttaaacgtacgtacggacgtacgtacgaaacgtacgaccgttacgtaccgtaacgttactacgggtaaacggtaacccggtaaccggggttaccctttaaccgttacccgtttacgttacgggttaccggtaaccgggtaacgggttaaagttaaaaccgtttaaccgttaaacgttaaccgtaaccgtttaccgttaacccgttttaccccttttaaacctaaccccgttttaccccgttaaggttaccctttaccggggtaccggtacccggtaacggttaccccgggtaacccccggttaaccccg

SEQ ID NO: 104888 - DNA, 882 bp, Homo sapiens
  misc_feature: GYAE6OF02HDW5I.17.34.D01.1.454.CMB.1.raw
  modified_base (185)..(185): a, c, t, g, unknown or other
  misc_feature (185)..(185): n is a, c, g, or t
  modified_base (283)..(283): a, c, t, g, unknown or other
  misc_feature (283)..(283): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggngcaatcgtggggctgaggtgaagcgcctgggtcctcggtgacgggtctacctgcaaggcttacgtggaggccaccgttcagcgacttatacggtttanaacgttgggtcgacggaccgggccttacggtcggacaagggtccccgttaggtacggttaggggaacgttacgggggaaacgggttacgtccgggttacccccgttaagtttacccggggtttaacggtaacccctaaaccgaaacccccttaaaaccgttaaccggaccccgaaaccgtaaaacgggttaaccgttacccggaacggggtacaaccgggtaaccttaacccaacccgaaattaaacccccgggacggtaaaacccgttaaaaagttaaacccggtaaaacctaaaccgtaaaacggttttaaacgttacggtaacgggtaacggtacccgttaaggaacctacggacccgttaacggtactaacgttccgtaagtacgggtaacccgtacggggttacttacccttacgttttccgttaggttcggtaaccggtaggtaaagttaaactttaccgttaactaacttacgttaccgttaccggttttaacctttttaccctaccccgtttaacccttttccggtaacccgtttccggttacccgggacccgtttaaccgggttacccggaccccccggtttaaccccgg

SEQ ID NO: 104889 - DNA, 801 bp, Homo sapiens
  misc_feature: GYAE6OF02FKQWC.17.34.D01.1.454.CMB.1.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgatttttccggattttgccctaggaaaaacccagcctaccccgacttaaaaccgggacaaaccgtcgccccggccaaacatagccttcgtccgtccccccttcgcagtaaccaccaagtacaggaatattaacctgttccatcgactacgcctttcggcctcgccttaggggtcactcacccgtgaccccgtaagttaaccgttggaaccacggtaaaccccttttgggtaccttccgggtacctacggcgggtccgtttttacaccccggtactttttacgtccgtttaacctttagtcgttacgacgtctaacgtttcgacctacgtttccgtgtaacttaacccctcgtacgtaccagtcgtcctacgtaactacgacctaccgtaaccctttacaaccgtaggtacccttaactaacggaaacccgtacccttacccccgtaaaacctaacccgtaaaccgcctaaacgtaaaccggtccgttacccgacgtccggacccgtaccgacggaccgtttcgggttaccgtccgtaagtttcccgggtttttaacccgtcccccggttttacctaaacgtttccccggtttaaccccgacccttaacgttcccgtacggtttaaccgttacgttacccgttaaccgg

SEQ ID NO: 104890 - DNA, 726 bp, Homo sapiens
  misc_feature: GYAE6OF02GI7W5.17.34.D01.1.454.CMB.1.raw
  modified_base (245)..(245): a, c, t, g, unknown or other
  misc_feature (245)..(245): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtccgtcggtgagggtctcctgcgagcttcgnggacgcaccttcacgcgactattagttacagttgggtgacggaccgggtcctcgtaggacgaacgggtcctttaggaggtgggaggtaggggaaggtacgtccggtcccgttagttcggttacgaaccaccgaacccaaaccgtacggaccaacgaacggtaacgttaccggaacgggacacgaaccgtaccaaccgaactaacccggacggtaaactaaaacgtaacgaaacaactaaagttaactcgtacggacgtactaagaacacgtccgtagtacgtactcgtaggaacggtaccgacggtcttacttacgttcgtcggtagacggtaaggtaaacttaacttaacgttaaattaaccgacgttcttacccttttacccgtttaaccttaccccgtttacccgtacgttacccgtttacgggttccgggtcccttaaccggtaccggggtaacccccgttacgtaccccgttcccg

SEQ ID NO: 104891 - DNA, 720 bp, Homo sapiens
  misc_feature: GYAE6OF02F4WUB.17.34.D01.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccacgtcccaggtccagtttggtgcaatcgtgggctgaggtgaagacgcgtggtccncggtgcggtctcgtgcagtcttgnggcgctaccgtgagacactatagttctaaggtttgggcgcggtacgggtcctcgtacggacaacggtccgtttgacggtgggtaacgtaggggaacggtcttccggtcccttaaggttccgttaggaaaccaccgtaaaccgtaaacctcgaaccacgtaacggtacgtaccgagggacacgactaccaaccacgtaaacccggcgaaacctaaacgttaaccgaaactacgtaaactttaacgtagtaggtacaacgtacggaactacgtcgttactactagtacctcgggaacgtaccggacgttccgttacctacgttttacgcggttacgacgggtaaacgttaacgtttaaacttaccgtaattaacccgtaccggttctttaaccgtttaccccttttaccgtacccctttcgttaaccggtttcctacggttccggtaacgtccggttacccggtaccccgtacccg

SEQ ID NO: 104892 - DNA, 695 bp, Homo sapiens
  misc_feature: GYAE6OF02HT9AT.17.34.D01.1.454.CMB.1.raw
  modified_base (186)..(186): a, c, t, g, unknown or other
  misc_feature (186)..(186): n is a, c, g, or t
  modified_base (262)..(262): a, c, t, g, unknown or other
  misc_feature (262)..(262): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggngcatctggggctgaggtgaagacgcgtcgggtcctcggtgtagggtcctcctgcaaggtctcgtggagctaccttnaggtacgataatagttactaagttgggtgccggacggcctcgtaggacgaacggtcctggagtcggagtagggaagtactccggtacctagtcgttacgaaccgacaacctaaaccgtacgccaacgtaaaggtaacgttcgaacgggtcaacgactaccaacccgtaactaacccggaacgggaacctaaaacgtaaaccgaaaccgtaacgtaaacgtttaacgtacgtacggtactacgtaacgtacgacgtaccgtgttacgacgttacgtacgacggtaccggtaggtccttacgtacgttcgtcggtagacgaggttaactaagtttaactacgttaacgtcgttacgtccttttaccgttttacctcccttccgttacgttaccgttcggtaccgggtacctacggtacccggtaccccgttaccg

SEQ ID NO: 104893 - DNA, 856 bp, Homo sapiens
  misc_feature: GYAE6OF02GY4JD.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggacggttcctctttgtggtggcagcagctacgaggtgtccagtcccaggtccagttggtgcaatcgtggggctggaggtgaagacgccgtgggtcctggtgacgggttctccgtgcaaggtcttcgtggacggtcctaccgttcaggaccgtacttaagttacgttttacaagtttcggggtcgaccgggaccgggtccctcgttacgggaaccgtaacgggtcctttaggacggttagggaacggttagggggaacggtactttcccggtacccttaggttccggttacggaaccaaaccgtaacccgtaaaaccgttacccggaacgtaaccgtaaggtaaaccggtttacccggaaaggggtaccaaacggtaccctacccgaaaccctaacggtaaacccggacgggtaaaacctaaaacgttaaaccgaaacctaacgtaaacgtttaactacggtacggaacgtacgtaacgaaccgtaccgtaccgtacgttactaacgttcgtaacggtaccggtacggtacggtcctttaccgttaccgtttcgtaggtcggtacggtaaacgggttaagttaaaccttaaccgttaacttaaccgtagtttaccggtttacccttttaaccgtttttaccctaaccccgttttacccgtttacgttaccggttttcccggtacgggttaccccttacggttacccccgggtaccccgttaaccccgg

SEQ ID NO: 104894 - DNA, 768 bp, Homo sapiens
  misc_feature: GYAE6OF02H7D1P.17.34.D01.1.454.CMB.1.raw
  modified_base (184)..(184): a, c, t, g, unknown or other
  misc_feature (184)..(184): n is a, c, g, or t
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (765)..(765): a, c, t, g, unknown or other
  misc_feature (765)..(765): n is a, c, g, or t
tcagcgtagactagcacgaccggtgctcgatttagatcgtctgtgttgggtttgggacaaaacaaccagattcctcctctaaagaacgccctgggagcacagctcatcaccatggactggacctggaggttcctcttgtggtggcagccagctacgaggtgtccagtcccaggtccagttggtncaatcgtagggctgaggtnaagtacgctgggtcctcggtgaggttctcctgcaaggtcttacncgggtacgctacttcgacgtaccgtacttacttaacgtttccgaaagtttcggggtacgaccggtaccgggtccttcgtacgggaactaaacggtccttacgggacgttcgggtaagttagggaacggtaacttccggtacccttagtcgttacggacctacgtaaccctaaacgttacgaccgtaacgtaacggtacgtttccgaaggggtaccaacgtacgtaccaaccgtaacgttaaccgacgtaactaaaagttaaccaacgaactaacgttaactacgtaaggaacgtacgtacgaaactacgtaccgtacgtacgtaacgtacgttacgaacggtaaccgtaaccggtacctttacgttaaccgtttcgttacgtacgacggtaacggttaacgttaaacgttactaaacgtacgtaacgttacgttaccttaccgttttaaccgtacccgtttaccgttaacgttacgttacggttcggaaccgtacgtacccggtaacccggtttaccntac

SEQ ID NO: 104895 - DNA, 736 bp, Homo sapiens
  misc_feature: GYAE6OF02IM89R.17.34.D01.1.454.CMB.1.raw
  modified_base (361)..(361): a, c, t, g, unknown or other
  misc_feature (361)..(361): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggtctccgtgcaaggtcttcgtggaggcctaccttcagcacttatagtttcaagttgggtgcggacggcctcgtggactaggtccttgagtggatggggaagctcgtccctagtcgtgactacaacctaaacgtacncacgagtaacgtccgagggacacgactaccaacctaacgtaacccgacggaaacctaaaacgtttaaccgaaaccaacgtaacgtttaaacgtaccggtaggtaacgacctaacggaaacctacggtacccttaggtacccagtttaccgaaggtaaccgggaaccgtaccgggtacttttacccgttaaccgtttcgttaggtacggacggtaacggttaactttaaacgttaactacgttaaaccacgttcgtacctttttaccccgttttaaccgtacccctttacccgtttaagtacccttttaccgggtacgggttacccctacggttaacccccggggtaaccccgttaccccgttacccgttaccccg

SEQ ID NO: 104896 - DNA, 972 bp, Homo sapiens
  misc_feature: GYAE6OF02INY8Z.17.34.D01.1.454.CMB.1.raw
tcagcgtagactagcacgaccggtgctcgatttagatcgtctgtgttgggtttggggatcacaaaaacaaccagattcctcctctaaagaagcccctgggagcacagctcatcaccatggactggacctggagttcctctttgtggtggcagcagctacgaggtgtccagtcccaggtccaggttggtgacatcgtgggctggaggtgaagacgccgtgggtcctcggtgaggtcctcgtgacgaaggtccttcgtggacggctaccgttcgagtcgaacttagttaacgtttccgtaaaggttggggtacgtccggaacccgggtcccgttcgtacggggtaaccgtaacgggtccgttttagggaaggtttaggggaacggttacgggggaaaggttaccgttcccggtttaccccgttaaggttaccggtttaaccgaacccgtaaccgtaaaaccccgtaaaaccgttaccggaacccgtaaacgtaaacgggtaaccggtttacccggaacggggtaccgtaacggtaacccgtaacctaaaccccggtaaacgttaaacccccgggaaacgggtaaaaaccctttaaaaaccggttaaaacccgtaaaaccgtaaaccgtttaaaacgggttttaaaccgttaaccgggttaaacggggtaaccgtaaccggtttaaaccgggaaaccgtaacccggttaccggttaccggttaccgttaacgtttaaccggacgggaaaacggggtacccggaacggggtttaccctttaccgtttaccgtttacgttacggtacggtaacccgggttaaaggggttaaacctttaaacgtttaaccgtaaacgttacccgtaacgtccgtttaaccctttttaacccgttttaccctaccgtttacccgtttacgttaacccgtttcgggtaccggtacccgtaaccggttccccgggaaccccgttaccccgg

SEQ ID NO: 104897 - DNA, 781 bp, Homo sapiens
  misc_feature: GYAE6OF02FRMSS.17.34.D01.1.454.CMB.1.raw
  modified_base (541)..(541): a, c, t, g, unknown or other
  misc_feature (541)..(541): n is a, c, g, or t
  modified_base (554)..(554): a, c, t, g, unknown or other
  misc_feature (554)..(554): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgcaattcgtggggctggaggtgaagacgccgtgggtcctcggtagagggtctccgtgaccgaggtcttcgtggacggtcctaccttcgacgtccgtactattagtttacaagtttcggggtgcggaccgggtccttcgtaggaccaaggtcccttaggacgttagggagttacggggaacggtacgtccggttaccctagtttccgggttaacgaaccgaccgtaaaccctaaaaccgttcgaccgtaaccgtaacggttaaacgttccggaacgggtacacggtaaccctacaaccgtaacgtaacccggacgtaactaaacgtaccgaaatacgtaagttacgatacggganactaggacgtacnccgttagacctagtcgtaggaccgacgtaccgggttcttaccgttacgttcgtaacggttcgaagggtacgttaaacgtttaaccttaagtaacccttaactaccggtttacgttaacccgtttttacccgtttaaccctaccccgttttacccggttaaccggtacccgtttagggtaccccggggtaccttaacccggtacccgggttaccccccggttaacccg

SEQ ID NO: 104898 - DNA, 648 bp, Homo sapiens
  misc_feature: GYAE6OF02F069L.17.34.D01.1.454.CMB.1.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (348)..(348): a, c, t, g, unknown or other
  misc_feature (348)..(348): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaaatctggggctgaggtgaagacgccgtgggtcctcgggtgagggtctcctgcaaggcttntggacgcaccttnagcgactatagtttcaattggtgcgacgggtcctcgtggacaaggccttgagtggactgggaaggatcgtaccctatcgttgaccanaccgaaactaacgcacaggtaacgttccgaggtacagactcaaccgataacccgtcggaacaaagttaacgaaacactaagtaaactacgttacggagtacttggaacaacgtcctaggtacaattcgtagaacgggtacacggggtacttccttacgtttacttggtacgccgtaagggattaaacgttactaattaacgtacgttacgtacctttacccttttaaccgtaccccttccgtttacgtaccctttacgggtacgggtaccctaaggtttacccggaccccggttaccccg

SEQ ID NO: 104899 - DNA, 704 bp, Homo sapiens
  misc_feature: GYAE6OF02H7O4L.17.34.D01.1.454.CMB.1.raw
tcagcgtagactagcacgaccggtgctcgatttagatcgtctgtgttgggtttggggatcacaaacaaccagattcctcctctaaagaagcccctgggagcacagctcatcaccatggactggacctggacggttcctctttgtggtggcagcagctacaggtgtccagtcccaggtccagttggtgcaatcgtgggctggacggttgaagacgtcctgggtcctcggtgagggtctccgtaggctaaggcttcgtgggagcctaccgttcagcgactatcgtttacaagttgggacgtcggacgggtccctgtaggacgtaacggcctttagacgttcgaagttgggaagcgtacggtccctagtacgtacgactaccgaactaaactcgcacagaacgttcgaaggctacgactacgacacgtaaccgcgtaacaaacttaacgaaccagtaacgtaactcgtagtacgccgttagaacgtacgaccgttacgtacgtaacttccgttacgaggtacccgaagggttcccttaccgtactttaccggtggtccctagggtaaacggtacgtaaacgtttacgaaacttaccgtacgtacgttccctttaccgttttaaaccgtccccgttacccgtttaggtacccttttaccgggttaccgggtaaccgtaccgttaaccccgggtacccccgttaaccgg

SEQ ID NO: 104900 - DNA, 854 bp, Homo sapiens
  misc_feature: GYAE6OF02G9N57.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgcaatcgtggggctggaggtgaagacgccgtgggtcctcgggtggacgggttcctccgtgacgaacggtccttcgtgggaggcctacccttcgaaggcgtaaccttagttacgttttactaaacgtttggggtacggccgggaaccggggtccttacggtaggggtaaccgaaacggggttcccgtttagggacggtttagggaacggttagggggaaacgggtacgttcccggttaccccgttaaggttccgggtttacgaacctaaccgtaaacccaaaaccgttaccgacaaaccgtaaggtaaccggtttaccgaacgggtacctaacggtacctaacccgaaacccgtaacgttaaaccccgggaccggtaaaaccgtaaaacgtttaaaaccgaaaccctaaaccgttaaacggttttaaacgtaccgttagggtacgtaccgtaagaaaccgtacgtccgttagtaccgtacgtcgttaggacggtaacggaccggtcttacgttaccgttacgtcggtcgtacgggtaaggtaacgttaacttaccgtaacgtaacttacgttacgttaccctttaacccgtttttacctacccgtttaccgttacgttaccgttcggttaccggtaccgtaccggttaccgggtaccccgttacccgg

SEQ ID NO: 104901 - DNA, 602 bp, Homo sapiens
  misc_feature: GYAE6OF02G5878.17.34.D01.1.454.CMB.1.raw
  modified_base (335)..(335): a, c, t, g, unknown or other
  misc_feature (335)..(335): n is a, c, g, or t
  modified_base (391)..(391): a, c, t, g, unknown or other
  misc_feature (391)..(391): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
  modified_base (483)..(483): a, c, t, g, unknown or other
  misc_feature (483)..(483): n is a, c, g, or t
  modified_base (516)..(516): a, c, t, g, unknown or other
  misc_feature (516)..(516): n is a, c, g, or t
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggaacagcagctacaggtgtccagtcccaggtccagttggtgcaatcgtggggctggaggtgaagacgccgtgggtcctcggtgagggtctcctgcaggcttcgtggaggccaccttcagccgacttatagtttacaagttgggtgccggacgggcctcgtggacgaggtccttgaggtggagtgggagngtcgtcctagtcgttgaccacaaccaactacgacacgagtaacgtcgaggcagacncacacaaccgcgaactaaataacgaacactaagttancgtggatctagaacngtcctgtacagtacgtagacggacacggtcttctacgttntggtacgacggtagtaattaacgtaacttaaanactacttcgtaccttttacccgtttactaccctttctacgtcttcggacgggtcctacggtacccggaccccgttctacccgtccg

SEQ ID NO: 104902 - DNA, 947 bp, Homo sapiens
  misc_feature: GYAE6OF02I824E.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtctccagtcccaggtccagttggtcgcaatcgtggggctggaggtgaacgacgccgtgggtcctggtcggacgggtcctccgtgacgaaggtcttcgtcgggacggtcctaaccgtttcgagaccggtaacttagttacttttaccgaaggttttcggggtacgcccgggtaacgggtcccttcggtacggaacgtaaacggggtccctttgggaacggttagggtaacggtacgggggaaaacggttccgtttacccgggttacccctttaaggtttacccgggttacggaaacccccgtaaccgtaaaaccccgtaaaaaccgtccggtaacctaaaccggttaaaacgggttaaccgttcccgggaaaggggtaacccgtaaccggtaacccttaacccgaaacccgtaaaccggtaaacccccgggtacggtaaaaccttaaaaccggtttaaacccgaaaccgtaaaccgttaacggtttaaaaccgtttcggtaacggggtaactacccggttaaacggaaacctaccgggttcccgttaagttacccgtaaacgttccgtaacggggtaaaccgaccgggtttccggttaaccgttttccttaacccgttaggttacgtacccggggtaaagttaaacggtaagtttaaaaccgtacctaaccgttaaccgtactaccggtttaccgttttacccctttaaacggccccctttacgttacgttaccgttaccggggtaccgtaaccctacgggttaacccggtcccccggttaaccg

SEQ ID NO: 104903 - DNA, 654 bp, Homo sapiens
  misc_feature: GYAE6OF02HJD1U.17.34.D01.1.454.CMB.1.raw
  modified_base (387)..(387): a, c, t, g, unknown or other
  misc_feature (387)..(387): n is a, c, g, or t
  modified_base (501)..(501): a, c, t, g, unknown or other
  misc_feature (501)..(501): n is a, c, g, or t
  modified_base (554)..(554): a, c, t, g, unknown or other
  misc_feature (554)..(554): n is a, c, g, or t
  modified_base (605)..(605): a, c, t, g, unknown or other
  misc_feature (605)..(605): n is a, c, g, or t
tcagcgtagactagcacgaccggtgctcgatttagatcgtctgtgttgggtttggggtacgatttgatgttacctgatgcttagaggtcttttcctggaagcagggcatttgttgcttcagcaccgtagtgcctcgtcatcacgcctcagccttgtatttttccggatttgcctaggaaaaccagcctacacgacttaaaccgggacaaccgtcgcccggccaacatacgccttcctcccgtcccccttcgcacgtaacaccaagtacaggaatacttaacctcttccatcgactacgcctttcgctcgccgttagggtcactcacctcgccccgtattacgtgaacacgacccttgtcttccggcgacgcggtctttcgacccgtntttactcgttacttatgtcacgtctacttcgacctacttcgtacgtactacctccacgctagtctcctcacgtacgacctacctaccttcaacgtcgtacttacacggtaaccncccttacccaacccaacgaaccgctaaagtaccgccgtccacgtcggacccgngtaacgtccgtttcggcgtacgtacgtttcggtttacccggtcccctttanacccgtttccttcccggacctacttccgttaccgtacttacgttacccg

SEQ ID NO: 104904 - DNA, 681 bp, Homo sapiens
  misc_feature: GYAE6OF02JPVB3.17.34.D01.1.454.CMB.1.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcatctggggctgaggtgaagacgccgtgggtcctcggtgacgggtcttccgtgccaaggcttactggaggctaccgttcagcgactagtagttcaagttggtncgtacggcctntggacaaggccttggagtggatgggaaggntaccgtcctagtcgttgacacgtaccgaaactcgacacaggaacgttccgaggcagactacaccacgtaaccgcggaactaaaatacggaacacgtagtaaactcgtaaggacgtactagaaaccgtaggtacccgtagtacgtaacgtcgttaacggaacgtaaccgtacccgggtactttaccgttacctttaccgtgggttaccggacgttaacggggtaatttaaacgttaaacgtaactaaccgtacgtttacgccgttttaccgtttaaacctccctttaccgtacgttacccgttcggtacgggtccttaaaccggtccgggttaaccccgtgtaaccccggttcc

SEQ ID NO: 104905 - DNA, 876 bp, Homo sapiens
  misc_feature: GYAE6OF02GZRLJ.17.34.D01.1.454.CMB.1.raw
  modified_base (258)..(258): a, c, t, g, unknown or other
  misc_feature (258)..(258): n is a, c, g, or t
tcagcgtagactagcacgaccggtgctcgatttagatcgtctgtgttgggtttgggacaaaacaaccagattcctcctctaaagaagccctgggagcacagctcatcaccatggaactggacctggagttcctctttgtggtgcagcagctacgaggtcgtccacgtcccaggtccagtttcggtgactaagtcgtggggcttggaggtgaagaccgcgttgggtcctcggtgagggtcctccgtgacgaggcttcgnggcgctaccgttcaggccgacttgtagtttacaagtttgggtacgcggtacgggtcccttgtaggaactaacgggtcccttagggacggtcggagttcgggggaaaacgggtctttacccggtaccccgttagttcccggtttacgggaaacctaacccgttaaacccgtaaaaccggttcggaacccgtaaaccgtaaggggtaaaccgttttaccccggaacggggcccgttaaggtaaccctttacccgaaaccgtaaccggtttaaaacccccggaccggggttaaaaccaaaaaacggttttaaacccgaaaaccgtaaccgttaaacgtttaaccgttaccgtaacggtacggttaccgtaagtaaaccgtacggtacccgttaggaccttaacgttcgttaacgggaaccgacgggttaccgggtccttacgttaccgtttcgtcggtctaaccgggtaggttaattaacggtttaactaacttaaccgactttaccgttcctttacccgttttaacccaccttttaccccgttaggtaccccgttttacgggtccggttaaccgtaccggtttaacccgggtaaccccgtttccgtaccccggttccccg

SEQ ID NO: 104906 - DNA, 811 bp, Homo sapiens
  misc_feature: GYAE6OF02HPPO0.17.34.D01.1.454.CMB.1.raw
tcagcgtagactagcacgaccggtgctcgatttagatcgtctgtgttgggtttggggagattcctcctctaaagaagcccctgggagcacagctcatcaccatggactggactggaggttcctctttggtggtggcagcagctacaggtgtccagtcccaggtccagttggtgcaatcgtggggctgaggtagaagcgccgtgggtcctggtgacggtctccgtggctaacggcttcgtagggaggcctaaccgttcgacgtacgtacgtaattacgtttacgaagttggggtacgcggacgggcctacgtaggacgtaacggtcttggagtggagtagggaagtacgtccgtccgtaagttcgtacgaacctaacaacccgaaagtcgactaacgagtaacgttaccgaggtaccagacctaccgaactaacgtaaaccggacgaaactaaaacgttaaaccgaaaccgaacgtaaagttaacgtaccgttaaggaacgtaccgttaacgaaaacgtacgtaaccgttagtaactaacgttcggtaacggtaacgggaacccgtacgggttaccttttacgtaaaccgtttccggtaacgttaacgggaaccgttaaagggaaaccgtttaaaaccgttaacgttaaacctaaaccgtaacggttcgtttaaccctttacccgttttaacccgtaacccttttcccgggttaattacccggtttacgggtaaccgggttacccctaacgggttaccccgggtaacccccgtacgtaacccccggttcccttaccccggtacctaccccgg

SEQ ID NO: 104907 - DNA, 782 bp, Homo sapiens
  misc_feature: GYAE6OF02JRRS5.17.34.D01.1.454.CMB.1.raw
  modified_base (184)..(184): a, c, t, g, unknown or other
  misc_feature (184)..(184): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttggtggtggcagcagctacaggtgtccagtccaggtccagttggtncaatctggggactgaggtgaagacgcgtggtcctcggtgagggtctccgtgacaggcttcgtgggacggctccgttcacgacgactagttagttctaagttggtcggccggacgggtcctcgtaggtacgaaggtcccttaggtacggtggtagtagggaacgggtactccgtaccttaggttcgttacgaaccaccgaacctaacccgtacgtacgaaccgtaacgtaacggttaccggaagggaccgaacgtacgtaccaacccgtaacgtaaacccggacggtaaacctaaaacgtttaaaccgaaccgaacttaaggttaacttcgaacgggactacgacgtaaacgacccgtacgtcgtactatacgtacgagggtactccggttccttaacttacgtcgttcggtacggtacgggaacgggtttaacttaaatttaaccgtaaattaccgttagttacccggttaaccctttttacccttttaacccggttcccctttacccgggttttaactaccggtttaccggtttacccggggtaccttaaccgggttaaccccggggtacccccgttaccgtacccgggttttcccc

SEQ ID NO: 104908 - DNA, 794 bp, Homo sapiens
  misc_feature: GYAE6OF02FUI3P.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgaggggtcctcctgcaaggtcttcgttgggaggccaccttcacgcgtactatagtttacaagttgggtagcgacgggctctagacgacgacgttcgagtaggagtagggaaggacgtacgtaccctagtacgttgaaccaccaaccctaaaccgtacgtaccaacgtaacgtaacgtttaccgacgggaccgtaagaaccgtaccaccgtaaccgtaaccgaacccgggaaacgtaaaactttaaaccggaacctaaacctaaggttaacttacgtaggacgtactacggtaaacaccgtaccgtacgtacctacgttaccggtagtaaccgggtaaccgtaccgggtaccctttaccgttacgttacccgttcgggtaggttacggtaaggttaacgtttaaacgttaaaccgttaacttaaacccgtacttacccgttaccgtttacccttttttaaacccctaaccgtttaccccgtttaaccggttacccgtttaccgggttacccggggtacccgtaccggtttaccccggggtaaacccccggttccgtaacccccggttacccg

SEQ ID NO: 104909 - DNA, 771 bp, Homo sapiens
  misc_feature: GYAE6OF02HP82Z.17.34.D01.1.454.CMB.1.raw
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtcgtccacgtcccaggtccagttggtgcaatcgtggggctggaggtnaacgacgcctgggtccttcgggtgtacgggttctccgtgcgtaaggtccttcgngggacggtccttaccgttcgacggcgtaacttaattacggtttactaacgttggggtcgtacggaccgggtcctacggtggaccgaacggtccgttaggacggtaggtaggtacgggggaaagtcgtaccgttccgtacgttcgtacgaccaaccgtaaccaaacgtaccgacaacacggtaacgttacgacggtacacgtaccgactaaccgaacgtaacccggaacgtaaacctaaaacgtaaaccgaaacgtaacgtaaacgttaaacgtaccggtaacggacgtaccgtaacgtaaacgcgttaacccgtacgtacgtaacgtcgtaacgggagtaacccggtccggtacctttaccgtacgtttcgtcgttacggacggtaacggttacttaaacttaactaaagtaacctaacgttaccgttacctttaccgtttacctaccctttcgtaccttacgtcggtccgtacgtaccgttacccggtacccgttacctaccgttacccg

SEQ ID NO: 104910 - DNA, 729 bp, Homo sapiens
  misc_feature: GYAE6OF02F2BC1.17.34.D01.1.454.CMB.1.raw
  modified_base (368)..(368): a, c, t, g, unknown or other
  misc_feature (368)..(368): n is a, c, g, or t
  modified_base (557)..(557): a, c, t, g, unknown or other
  misc_feature (557)..(557): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctcttgtggtggcagcagctacaggtgtccagtcccaggtccagttggtgcaatcgtggggctgaggtgaagacggcctggggcattcagtgactgtacctcgtgacgaaggccaggtcggatatagtcttcgaactaaagttagtggtatagtaagtttgggtagacgtacgaccgggcccccggaagaaggggtccttaggaggggttgggggttggggtacgggtacgngggtaccgggtcttttacgggacggttaaaggcctaacggtagtacgtcgaccgtaacggaaggtacgtagggaaagggccgtaaaggtacgtaccgaaccggtaacgttaacccgaaccgggtacccaaacccccgaagaaaccgtaccgaacgtccgtaacacgtccgacgtaaccgtaggaaccgngacctaggacgaggtaccgtagaaccggtaccgaccggttccgtaagttaacgtaccgtaggtacgaccggtaagttactttcggtttcgtacgttaccgttaacgttaaccgttaacgtttaacgtttacggtacgttaccggttacgtttcgttaggtaccggttaacgg

SEQ ID NO: 104911 - DNA, 671 bp, Homo sapiens
  misc_feature: GYAE6OF02HDV7M.17.34.D01.1.454.CMB.1.raw
  modified_base (268)..(268): a, c, t, g, unknown or other
  misc_feature (268)..(268): n is a, c, g, or t
  modified_base (306)..(306): a, c, t, g, unknown or other
  misc_feature (306)..(306): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccaggttggtgcaatcgtgggctggaggtgaagcgccgtgggtcctcggtgagggtcctccgtgacgaacggtcttcgtggagcctaccttnagcgactatagtttcaagttggtgcggacggtcctcgnggacaagtccgtagagtggagtagggaagtcgtcgtcctagtcgtagacacacaactacgcgacagtactcgaggacacgtactacacactaaccggacgaacaaacgttaaccgaaccacgtaagttaacgtcgtagacggtacaacgaacgtacgtcttacgtactacgtcgtaagaacggtaccgacggttaccttacgttaccgttcgttcgtacggtacgtaaggtaaacgttaaacgttacgtaacgtaactacgttacgttacccttttacccgtttaacctaccccgtttacccgttaggttaccgtttaccgggtaccgggttacccgtaacgttacccgggtaaccccgttcccg

SEQ ID NO: 104912 - DNA, 814 bp, Homo sapiens
  misc_feature: GYAE6OF02GTOUI.17.34.D01.1.454.CMB.1.raw
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttggtggtggcagcagctacaggtgtccagtcccaggtccagttggtgcaatcgtggggctgaggtgaagacgccgtgggtccgtcggtggaggtctccgtgcgaacggtcttcgtggacggcctaccgttacacggcgtaacttagttaagtttacgtaagtttgggtggccggtaccgggtccttcggtacggacgaacgggtccgtttacggagggttcgggaggttagggggtaaggtacgttccggttcccgtacgttccggttacgaacctaaccgtaaccgtaaaaccgtaaccgaccgtaacgtaaacggtaacggttaccggaacgggacgtaacgaacccgtacctaaacccgaactaaacccggaccggaaaccgtaaacgttaaaaccggaactaacggtaaacttaacgtacgtagggtaaacgtacgtaacaccgtacgtacccgttacggttaacctaacgttccggtaacgtaacggtaacggtacccgggtctttacgtaactttcggtacgttacgggtacgtaacggaacgtttaaactacgtaaattaccgtactacggtttaccctttaccgttttaaccctccgttacccgtttagtacccgtttacggttccggaccggtttaacggtacccgggtaccccgttaccccg

SEQ ID NO: 104913 - DNA, 789 bp, Homo sapiens
  misc_feature: GYAE6OF02I0R68.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtccccaggtccagttggtgcaatcgtggggctggaggtgaagacgccgtgggtcctcggtgagggtctcctgcaaggtcttcgtggacgctaccgttcacgcgtactattagtttcaagttgggtgcgacgggcctcgtggacaaggtccttaggagtggagtaggggaagcgttccgtacctagtcggttagaccacctaaccaaactccgacaacgaaggtaacgttccgaggacacgtaacctccgaacctaacgtaacccggacggtaaactaaaaacgttaacgaaaccacgtaagtttaaactcgtaggtagccgttaagaacgtacgtaccgtgtacctaacgtacgtacggacggtaccggaccggttaccgtttcccgttaacgttccgttacggtacggtacggtaacggttaacgtttaaacgttaaaccttaagttaacccgtaacgtttaccggttacccctttttaacccgttttttaacccccgtaacccttttaccccggtttaacgtttaaccccgttttaccgggttacccggggtaaccctttaaacccgggttaccccgggtttaaaccccccggttaccccggttccgttttaaccccccgg

SEQ ID NO: 104914 - DNA, 924 bp, Homo sapiens
  misc_feature: GYAE6OF02IMB9F.17.34.D01.1.454.CMB.1.raw
  modified_base (191)..(191): a, c, t, g, unknown or other
  misc_feature (191)..(191): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggagttcctcttggtggtggacagcagctacgaggtcgtccacgtcccaggtccaggttggtnacaatcgtgggctaggaggtgaacgccgccgtacgggtccgtcgggtcgtacgggtcctcgtggacgtacggtccttacgtgggacgtcctaccgttcacggtacgtacttagtttacgttttaccgaaggttttcgggaccggtaccgggtccgggtccctacggtacggaaccgtaacgggttcccgttagggtacggttagggtaacggttacgggggaaagtccgttaccccgggtttaaccgttacggtccggtttaaccgaaaccgtaaacccggtaaaccccgtaaaacccggttacccggactaaacggtaaaggtaacccggtttcccggaaaggggacctaaacgtacccgtaaccaaccgttaacccggtaaccgggtaacggtaaacctaaaaccgttaaaccgaactaaaccgttaacggttaacgtacggtaagtacgaccgttaaagaacccgttacgaccgttacgtacgttaaccgtacggtaacggaccgtaccggttaaccggtccgttttaacggttcccgttacggttacgggtacgggttaaccgggttaaagggttaaacctttaaaacgttaccgtaaagttaccggtaacctttcccgtttaccgtttttaaccccgttaacccttacccccggtttacttacccggttacggtttacccgggtccggtacccgttaacgggttacccccgggttaaccccttcccgg

SEQ ID NO: 104915 - DNA, 833 bp, Homo sapiens
  misc_feature: GYAE6OF02HQWWZ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccacgtcccaggtccaggttggtgacaacgtcgtggggctcggaggtagaacgcgtccgttgggtcctgggtagacggtcctccgtcgacgaacggtccttacgtcgggacggcctacctttcgagtccgtaacttagtttacgtttaccgtaagtttcggggtcgtaccggtaccggggtccttacgtacgggaccgtacgggtccgtttaggacggtagggaacgggttaggggaaggtacgtaccgttacccgttaagttcgttacgaacctaaccgaaacccgtaaacgtccgaccaactacggtaacgtaccggaggacaacgtacctacacccgtaactaaccggacgtaaacctaaaacgtaaccgaaaccaagttaaacgtttactaggacggtacgtaccgtaaggtaccgtacgtccgttacgtaccaacgtcgtaacggaacggtaccggtaaccgggttcctttaccgttaccgtttcgtagggttacgtaaccggggtaagttaaacgttaacttttaacccggtaatacccgtttaccgttaccgttaaccctttttacccttttaacccgtaccccttttacccggttacgtttacccggtaccggttccggaaccccgtttaacggttcccccgggtacccgttaaccccgg

SEQ ID NO: 104916 - DNA, 906 bp, Homo sapiens
  misc_feature: GYAE6OF02I0L2K.17.34.D01.1.454.CMB.1.raw
tcagcgtagactagcacgaccggtgctcgatttagatcgtctgtgttgggtttggggatcacaaaacaaccagattcctcctctaaagaagccccctgggagcacagctcatcaccatggactggacctggaggttcctctttgtggtggcagcagctacaggtgtccagtcccaggtccaggttggtgcaatcgtggggctgaggtgaagacgcctagggtcctcggtgagggtctccgtgcaaggcttcgtaggacggcctaccgttcgacgtccgtacttagttacgtttacgtaagtttgggtcggaccggtaccgggtccgtcgtcggaacgtaacgggtccctttaggacggttgggagtacggggaaggtacgttaccgttacccgttagttccggttagtaccgaaccgaaacccgtaaaccgtaaccgtaccgtaacgtaacggtaacggttaccccccgaaggggtaaccaacggtaacccgtaccgaaaccccgtaacggtaacccgggtaacccggaaacgttaaaacgttaaacccggtaaaaccgtaaaccgttaaacggttttaaaacgtaccggttaacggtaaggtaacccgttaacggaaacccgtaacggttacccgttacggttaccgtaaacgttccggtaagggaaacccgggtaccggttaacccggggttaccttttaaccggttaccgtttccggttacgggtacggttacgggaaacgggttaaactttaaacgttaacgttaacgttaaccgtacgtttacccggttacctttttaccccgttttaacccgttaccccgtttacccgtttaccgttaccggtttaccggtacccgggttaaccgtaacccggttacccgggtacccccgttaaccccgg

SEQ ID NO: 104917 - DNA, 602 bp, Homo sapiens
  misc_feature: GYAE6OF02I9HW1.17.34.D01.1.454.CMB.1.raw
  modified_base (328)..(328): a, c, t, g, unknown or other
  misc_feature (328)..(328): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagcgtagactagcacgaccggtgctcgatttagatcgtctgtgttgggtttgggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttcgtggaggcacttcagcgactatagtttcaagttgggtgcggacgggcctcgtggacaaggccttggagtggagtgggaaggntcgtcctatcgttgacacaaccaaactcgacacgaagacgttccaggcagactcacacgtaaccgcgaacaactaacgaacacaattaatctagganctagaacngcctgatactctgacggaccgacgggtccttaccgtactttcgtacgtcgacgtaggtaacttaattaacttaacgtactacgttacgtccttttaccttttacctaccctttcccgttacgtacctttccggtacgggtcctacggttacccgggtaccccgttaccg

SEQ ID NO: 104918 - DNA, 964 bp, Homo sapiens
  misc_feature: GYAE6OF02G5PIT.17.34.D01.1.454.CMB.1.raw
tcagcgtagactagcacgaccggtgctcgattttagatcgtctgtgttgggtttggggatcacaaaacaaccagattcctcctctaaagaagcccctgggagcacgacgctcatcaccagtggactggacctggaggttcctcgtttgtcggtggctagcagctacgaggtcgtaccaagtcccaggtccctagttcggtcgacctaagttcgtggggcttaggtacggtacggaacgtaccgtccgtacgggtcccgtacgggtggtaacgggttcctccgttaggacctaaaggtcctttacggtacgggacggtacctaccgttacgacgtaccgtacgttacgttacgtttccgtaagttcggggtacgtaccggtaccgggtcccttacggtacgggtaaaccgtacgggttaccgttagggtaacggttacgggtaacggttaacggggtaacggttacgtttacccggttaccggttaacggtttaccggttaacgtaccgtaaaccgtaaccgtaaaccgttaccggtaccgtaacggtaacggtaaaccgggttaccggaacgggtaacctaacggttaccctaaccggaaccgtaaacggtaacccggaacggttaaaaccgtaaacgttaaacccggaaaccttaacggtaaacggttttaaccgtacggtaacggtaacgtaccgtaacggtaacccggtacgtacccgtttaacgaacgttcgaaccggtaacgtaccgttaccggtactttaccgttaccgttacggtacgggttaccgacgggttaaacgtttaaccgttaaacgttaaccgttaaacggtaaccttaccgttaccgttaaccgtttttacccgtttacccgttacccgtttaccggttaccgttaccgttacccggtaccgggtaacccttaccgggtttaacccggtaccccgttacccgttaccgg

SEQ ID NO: 104919 - DNA, 669 bp, Homo sapiens
  misc_feature: GYAE6OF02I2G9T.17.34.D01.1.454.CMB.1.raw
  modified_base (319)..(319): a, c, t, g, unknown or other
  misc_feature (319)..(319): n is a, c, g, or t
tcagcgtagactagcacgaccggtgctcgatttagatcgtctgtgtttgggtttgggggacaaaacaaccagattcctcctctaaagaagcccctgggagcacagctcatcaccatggactggtacctggaggttcctctttgtggttggcagcagctacaggtgtccagtcccaggtccagttggtgcaatctggggctgaggtgaagacgtccgtgggtccctgggtgagggtcctcctgcaaggtcttcgtaggacgcaccttcagccgtactatagtttcagttgggcgcgacgggcctgtgacaacgtcgtagnggtggagtaggggaaggtctccgtccttagtcgtaggacaccaacactacgacacgagtacggtcgaggcacactacgacgtacgaccgacgaacgaaacttaacgaacaacgtaaacttaacgtccggtaggtacgacgttaacgacgtacgtccgtacgtacgacgttaccggaggaacggacccgtaggttaccttccgttacttcggtgtcgaacggtaggttaacgttaacttacgtaagtaaccgtcgttctaccgttttaccttttacaccccgtttacttcggtacctttccgggtacggtaccgaccggttaacccggtacccggtccgttaccgtacccg

SEQ ID NO: 104920 - DNA, 747 bp, Homo sapiens
  misc_feature: GYAE6OF02GNW0G.17.34.D01.1.454.CMB.1.raw
  modified_base (129)..(129): a, c, t, g, unknown or other
  misc_feature (129)..(129): n is a, c, g, or t
  modified_base (251)..(251): a, c, t, g, unknown or other
  misc_feature (251)..(251): n is a, c, g, or t
tcagcgtagactagcacgaccggtgctcgatttagatcgtctgtgttgggtttggggagattcctcctctaaagaagcccctgggagcacagctcatcaccatggactggacctggagttcctctttgnggtgcagcagctacaggtgtccagtcccgaggtccaggttggtgacaagtcgtggggctggaggtgaagcgccgtggtcctggtgaggtctcgtgacgaggtcttgtggacgcctaccgttnagcgacttagtagtttacaagttggtacgccggacggccgttcgtacggacgaacggtcgttgacggtggagtacgggaaggacgtccgtcccgttagtccgtagacaccgaaccgaaacgacacgacgtacgtaacgtacgaggacagactacgaaccacgtaacccggacgtaacgtaaattaaaccggaaactacgtaagttaaacgtccgtaagggacgtaaccgtacggtaacgaccgttccgtaagttaccgtaactccggtaacggtacggaaccggtacccggttaccgtttaccgttacgttccgtggtacggacggttaacgtaagtttaacgttaccttaaagtaacccgttagttacccgttactttttacccgtttacccttaccgttccccgtttagtacccgtttccggtaccggtacccgttaacggttacccgggaccccgtttaccgtaccccggttcttacccgtacccgtaccccg

SEQ ID NO: 104921 - DNA, 928 bp, Homo sapiens
  misc_feature: GYAE6OF02J1T5M.17.34.D01.1.454.CMB.1.raw
  modified_base (212)..(212): a, c, t, g, unknown or other
  misc_feature (212)..(212): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtccaggtccagttggtgcaatcgtggggctgaggtgaacgcnccgtgggtcctcggtgagggtctcctgcgtaaggctttcgtgggagcctacctttacgacggtccggaacttagttaagttttccgtaaaacgttttgggggttacggacccggtaccgggggtacccctttacggtcgggtaacccgtaaaacggggtccccttttaggtaaccgggttgggtaacgggttgggggtaaaacggttcggttacccggtttaccccgtaagtttccggtttaccggaacctaacccggttaacccgaaaaccggttaccggaacccgtaaccgtaaacgggttaaccggtttacccgaacgggggtacctaaacggtaccgttaccgaaccccgttaaacggtaacccgggttaccgggtaaaccttaaaaggtttaaaccccggaaactaacccggtttaaacggttaacgttacggttaacgggtagtaacgttacggtaacgtaacccgcgttacgttaaccggtaacgttcggtacgggtaacggtacccgggttacggttacctttaccgttaacgttttccggtacgttacgggaacccgtttacgggttaacgttaaacgtttaaccgttagttaaacccggttcgtaccggtttactttttaaccccgttaccttaaccccgttccctttaccggttaacctttcgggtacccgtacgttaccggttacgttaccccgggttaacccg

SEQ ID NO: 104922 - DNA, 783 bp, Homo sapiens
  misc_feature: GYAE6OF02ILNMM.17.34.D01.1.454.CMB.1.raw
  modified_base (96)..(96): a, c, t, g, unknown or other
  misc_feature (96)..(96): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
tcagcgtagactagcacgaccggtgctcgatttagatcgtctgtgttgggtttggggtacgatttgatgttacctgatgcttagaggtcttttccnggaagcgagggctatttgttgcttcagcaccgtagtcgcctcgtcatcacgcctcagtccttgtacgtttttcccggattttcggaccgtaacggaaaaacccacgtccctaaccccggaccgttaaaacccggggaccaaaccggtccggccccggaccaaactagtacgtccctttcccgtcccccgttccccccttaggactaacgtaaaccaaccgtaaaggtaccgaaggtaaacttacgttaacccttcgtttacccagtaccgactaccggtcctttccggccttcggtccgttagggtcctactccaccgtcgaccccgtattacgtcgacacggtaccttgtctccggngcggcggtctttcgaccgtnttagtcttatctgtcatctatcactcttactagtaacctccgtacacggctacgccgtcctacgaccgtacaccctacttacctacgtaccggacgttcctaaacgtaaccggtacccgtacccctaacccgtaaacccgaaaccaaccgactaaaccgttacggacccgtcggcctaccggccgtaacgtcggttacccgtttagggcccgttacttaaccggtttccggttacccgttcccgttccgttaccttcccggtacctaccgttaccgttccgttaccggtacttaccgttacgtacccgg

SEQ ID NO: 104923 - DNA, 715 bp, Homo sapiens
  misc_feature: GYAE6OF02I9KET.17.34.D01.1.454.CMB.1.raw
  modified_base (245)..(245): a, c, t, g, unknown or other
  misc_feature (245)..(245): n is a, c, g, or t
  modified_base (378)..(378): a, c, t, g, unknown or other
  misc_feature (378)..(378): n is a, c, g, or t
  modified_base (603)..(603): a, c, t, g, unknown or other
  misc_feature (603)..(603): n is a, c, g, or t
tcagcgtagactagcacgaccggtgctcgatttagatcgtctgtgttgggtttgggacaaaacaaccagattcctcctctaaaagaagcccctgggagcacagctcatcaccatggactggacctggagttcctctttgtggtggcagcagctacgaggtgtccagtcccgaggtccagttggtgcaatcgtggggctgaggtgaagacgctgggtcctggtgaggtctctgacgaggtcttcgnggacgcgtaccttcgacgtcgaacttagttacgtttctaaggtttgggtcggcggaaccgggtcctacgtgggaactaacgggtccttaggaggtagggtagtagggaaggcgttccgtccttagttcggtanaccgacaaccctaaacgtaccgactaacgacgtaacgttccggaagggacctaagacctaccgaaaccgtacgtaaacccggaaggtaaacctaaaaacgtttaaaccgaaacctaaccttaaaggtttaactaaccggtggaacgtactaacgaaacgacgtaccctgtacacttacgaggtacgggaaccgtcggtttccttacgtttacgtcgtcgtaacgnggtaaagttacttaagtaacttaacacgtgttccttacttttaccgttcctaccgttccttacgacgtttccgtacggtcgtacgttaccccggtaacccgtccacccgttc

SEQ ID NO: 104924 - DNA, 872 bp, Homo sapiens
  misc_feature: GYAE6OF02F4YT8.17.34.D01.1.454.CMB.1.raw
  modified_base (271)..(271): a, c, t, g, unknown or other
  misc_feature (271)..(271): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggacgttcctctttgtggtggcagtcagctacgaggtgtccagtcccaggtccagttggtcgcaagtcgtggggctggaggtgaagacgtccgtgggtacctggtgacggtctccgtgcaaggtcttcgtggaggtcctaccgttnacggtcgtaactagttacgtttaccgaaagtttcggggtacgaccggaccgggtaccccttacggttacgggaacccgtaaaggttcccgttttaggacgggttacgggtaacggttagggggaaacggttacgttcccggttaccccgttaaggtttaccgggttaccgaacccgtaaccgtaaaccctaaaaccgttaccggtacgtaaccgaacggttaaccgttacccggtaacggggtaacctaacggtacccttaacgaaacccgtaacgtaaaccccggtaaccggtaaaacctaaaaacgtttaaacccggaaaccgtaacgttaaacggtttaacgtccggttaagggaacgtaaccggttacgaaaccgttacggtcccgttaagtaccgttaatcgtaacgggaacgtaccggtacggttacctttaccgtaacgttcgttagtcggtaacggtaacgttagttaaacgttacttaacgacgttaccgttacgttaccgttttacctttaaccgacccctttacgttacgttacgtttaccggccgggttacctaccggacccggttaaccccgttcgtacccgttcccc

SEQ ID NO: 104925 - DNA, 688 bp, Homo sapiens
  misc_feature: GYAE6OF02II1JA.17.34.D01.1.454.CMB.1.raw
  modified_base (313)..(313): a, c, t, g, unknown or other
  misc_feature (313)..(313): n is a, c, g, or t
  modified_base (468)..(468): a, c, t, g, unknown or other
  misc_feature (468)..(468): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggccagcagctacaggtgtccagtcccaggtccagtttggtgactaatcgtggggctggaggtgaagacgtccgtgggtccagggtgacgggttcctccgtgacgaaggtcttcgtgggagctacccgttgacgacgactatatttcaattgggtgcgacggctgnggacaaggccttggacgttggatcgggaagtctcgtccctatcgttgaacacaccaaaactcgacacacggaacgttccgaagggtccaagacctacctaactaactaacccggacgaaccgaaaatttaaaccgaaacaacgtaacgtttaaanacggtaggaagcttaacggaacaggtaccctaggtactagtaccgtgacggtaaccacgggtacctttacgtacctttacgtcggtagacgacgggtaaacgttaaattaactaacttaaaccgcttcggtacctttacccttttaaccgaaccctttccgtttaaccgtccgtttaccggtgggtaacccgtaagtcccgggtaaacccccgttcccgg

SEQ ID NO: 104926 - DNA, 922 bp, Homo sapiens
  misc_feature: GYAE6OF02HMCNB.17.34.D01.1.454.CMB.1.raw
  modified_base (120)..(120): a, c, t, g, unknown or other
  misc_feature (120)..(120): n is a, c, g, or t
  modified_base (660)..(660): a, c, t, g, unknown or other
  misc_feature (660)..(660): n is a, c, g, or t
tcagcgtagactagcacgaccggtgctcgatttagatcgtctgtgttggggtttgggtacgatttgatcgttacctgatgcttagaggtcttttcctggaagcagggctattgttgcttnagcaccgtagtgcctcgcatccaacgtcctcaggtccttagtacgttttccgatttcggaccgtacggaaaaaccgtcgtacccgtacccgtaacgttaaaacccgggacctaaccggttcgaccccggtacctaaacgtctaacggttcctttaccgtccccggttacccccccgttgaccgtaacggtaacctaaacccgtacgttaacgaacggaactttaaacttaaaccctttccggttacccctaagtacccgaccgttaccggttaccgttttcccggtccgttaaccggtccgtttaacggggggtcctaaccgtttcccaccccggtaccggtacccccgttaaaacggttttaaccggtttacggggaacgtaaaccggggttaaccccgtttcggttaccgtttaccgggacccggtaacggtcgggttcctttttaacccgccggttaactttacgaccgtttcgttagtacgtcaacggtactacgtttccgtactaaccgtttactacggtacctttaccgaaccncggttactacgtccgtactacctacgtacgctaaccctacacggtacgaccgtaactaaccgaacgtccctaacccgtaccctaacccgaaacgacctacgtaaacgttaccggtacggtaccacggaacgtacccgttaccgtcggtaccttttccgggaacgtttagttaacccggttacggtttcccgttacccgtttcgtaaccgttcccgtacccggttctacgtaccgttcgttaaccgttacgtccccgttaagg

SEQ ID NO: 104927 - DNA, 642 bp, Homo sapiens
  misc_feature: GYAE6OF02F5NIJ.17.34.D01.1.454.CMB.1.raw
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
tcagcgtagactagcacgaccggtgctcgatttagatcgtctgtgttggggtttgggggtacgatttgatgttacctgatgcttagaggcttttcctggaagcagggcatttgttgcttcagccaccgtagtgcctcgtcatcacgcctcagccttgtattttccggatttgccctaggaaaaccagcctacacgcgttaaaccgggacaaccgtccgcccggaccaaacatacgccttctccgtccccccttgcacgtaacaccaagtacaggaactacttaacctgtttcccatcgactaccgtcctttccggcctacgcgttaggggtcgactcacccctcgcccgtattaacggttggacacggtacccttggtctccggcgagcgggtctttcgaccgtctttactcgttacttatcgtacagtctactcgctactctgactacctccngcacgtcncctacacacnccaactaccttacacgtacgtactaacgactaaccgccctaccctaacccaacaaacgacaactacgccgtcgcctcgccgcgtacgtcgtcgcgtacgtaggtttcggttaccttacccgtttacctccgttcccttcccgcctagttaccgtacgttacgttacgtcg

SEQ ID NO: 104928 - DNA, 895 bp, Homo sapiens
  misc_feature: GYAE6OF02H2WNV.17.34.D01.1.454.CMB.1.raw
  modified_base (141)..(141): a, c, t, g, unknown or other
  misc_feature (141)..(141): n is a, c, g, or t
tcagcgtagactagcacgaccggtgctcgatttagatcgtctgtgttgggtttgggatcacaaaacaaccagattcctcctctaaagaagcccctgggagcacagctcagtcaccatggactggacctggagttctcttgngtggcagcagctacgaggtgtccagtcccaggtcctagttggtgctatcgtgggctgtaggagtagacgccgtggtcctcggtgacgggtctccgtggacaacgggtcttcgtagggacgtaccgtaccgttcgaacgacgtaccgttaagttaagttttaccgtaaaggtttaggggttcgtaccgggaaccggggtaccctttaccgttagggaaccgtaaaacgggtccttaaggtacgggttacggtaccggttaggggtaacggtaaccgttccgggtaccccttaaggtaccgtttaacggaacccttaccggaaaccttaaaccgggttacccaaccgtaacgtttacgggaaaccgttttacccgggaacgggaacctaccgtaccgtttaaccgaacccgtaaacgttaaacccggcggtaaaaaccgttaaacgttaaacccgtaaaccgtaaacccggttaaatttaaacggtaaccgttttaacggaaccgtaacgtaacgttaaaaccgagtccccgttacgacgttacggaccgttggaaaccgggtccctaggtacccgtttaccgtaaccgtttcccgtaggtacggaccgttaacggtaaacggtttaactttaaccgtaacgttaagtaccccgtttacgtaaccccgttttcttttaacccgtaaccggtttacccttaacgttccgtttaacgggtacccgacgtaaccgtttacccggaacccggttaccccg

SEQ ID NO: 104929 - DNA, 976 bp, Homo sapiens
  misc_feature: GYAE6OF02HO1CN.17.34.D01.1.454.CMB.1.raw
tcagcgtagactagcacgaccggtgctcgatttagatcgtctgtgttgggtttggggatcacaaaacaaccagattcctcctctaaagaacgcccctgggagcacagctcatcaccatggactggacctggaggttcctctttgtggtggcagcagctacaggtgtccacgtcccaggtccaggttggtgcaatcgtaggggctggacggtagaagaccgccgtacgggtccgttcgggtacggagggtcctaccgtggacaaggtccgtttacgtgggacggccgtaccgttcacggaccgtaacttacgttacggttttactaacggtttggggttacggtacgggtaccggggtaccgttccggtaacggtaaccggtaaaccggggtacccgtttagggtaacgggttaggggtaacggttaagggggtaaacgggtacgttacccggttacccccttaaggtttaccgggtttacggtaacccgaaccgtaaaacccgtaaaaccgtacccggacccgtaacaaacgggttaaaccggtttacccgggaaacggtaccggaaaccggtacccgtaaccgaaacccgttaaccgtaaaacccgggtaacccggtaaacctaaaacccggttaaacggtaaaaacctaccgtaaaacgttttaacgtacggtttacgggaacgtttaccggtaacgaaacgtaccgacccgtttacgacgttacgttacgtcggtaaccgggtaaccgaccggttaccgttttacccgtacgtttaccgttacggtcggttaaccgggtaaacgtaaacgtttaaacgttaaccgtttaacgtaaccgttaccgtttacggttacccttttaccccgttttttaaaccctaccccgttttaacccgtttgggtttaaccccgttttcggaccgggggttaacccgtttacgggtttacccccgggaccccgtttaacccccgg

SEQ ID NO: 104930 - DNA, 924 bp, Homo sapiens
  misc_feature: GYAE6OF02IMA75.17.34.D01.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
tcagcgtagactagcacgaccggtgctcgatttagatcgtctgtgttgggttgggatcacaaaacaaccagattcctcctctaaagaagcccctgggagcacagctcatcaccatgactgacctggagttcctntttgnggtggccagcagctacaggtctccagtcccgaggtccgagttggtgacctaagtcgtcggggctaggtaggtaggaaacgtaccggccgttcggggttccctgggtcggtagggttcccttccgtggtacgaaggtcctttcggtacgggacggtccttaaccttcgagtaccgtaacgttaagtttaccggtttcgtaaggttcggggttaccgacgggtacccgggtccgtccgtacggggtaacctaaccggggttccgttttaacggtacgggttagggtacgtagggggtaaaccgtaccggttccgtttcccgtaagttcgttaccgaaccgtaccgtaaaccgtaaacgttccgtaccgtaaacccgtaagtaaccgtttaccgggaaaccggtacgtaaccgttaacgacctaaccggtaacttaaccccggacggtaaaccttaaacgtaaccgtaaccgtaaacgttaacgttaaaccgtacgtaacgggtaccgtaccgtaacggaacgtaacccgtcgttaaccggttatacggttaccgtaggaacgggttaccggttacggttccgtttaagttcccggttatacgggtttacgaggtaaaccggtacgtttaaaacggtttaacttaaccgtacttaaccggtttcccgttaaccctttttaaaccccggttttacccttaaacccggtttacccctttaaggtacccccgttttacgggtaccgggttacccgtaaaccgggtttcccccggtaaaccccggtcccccg

SEQ ID NO: 104931 - DNA, 888 bp, Homo sapiens
  misc_feature: GYAE6OF02HE08N.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcgaaggtcttcgtggaggctaccgttccgagccgtactagttacgtttcgtaaacgtttgggggtacggtccgggaaccgggggtcccctacggttacgggaaccgtaaacgggggtcccgttttagggaggggtttcggggtaacggttagggggggtaaacgggtacgtttacccgggttaccccgttttaaacggttcccgggttttacggaaaccctaacccgaaccccgttaaaaccgttaaccggacccaaacgtaaggtaaaccggtttacccgaaggggacctaacgggtaacccttaccgaaacccgtaaacgttaaaccccggaccgggtaaaccgtaaaaccgtttaaacccggaaacctaaccggtaaaggtttaaactacgttacgggaacgtacgttacggaaccgacggtacccgttgtaccctacgtcgtacggacgggtaaccgtccgggtaccgtttaccttaccgtttccggttagtcggtaaccggtacgggtaaacgttaaacgtttaacgttaacgttaactacgtttccgtaaccttttacccgtttttacctaaccccctttccgtttacgttcccgtttacgtccggggtaaccctaggttaccccgggtaaccccggttacccg

SEQ ID NO: 104932 - DNA, 803 bp, Homo sapiens
  misc_feature: GYAE6OF02HI5BG.17.34.D01.1.454.CMB.1.raw
tcagcgtagactagcacgaccggtgctcgatttagatcgtctgtgttgggtttggggacaaaacaaccagattcctcctctaaagaagccccctgggagcacagctcatcaccatggactggacctggagttcctctttgtggtggcagcagctacaggtgtccagtcccgaggtccagttggtgactaatcgtggggctaggaggtgaacgacgtccgtgggtcctcggtggacggtctacgtcgacgaggtccttcgaggacggcctaaccgttcgaacggtaccgtaacttaagttacggtttaccgtaaaggtttcggggtacgaccgggtaccgggtacccgttcgtaggaaccgtaacgggtccttaggacggttggaggtacggggaaggtacgttccgtaccccgtaatcggttagaaccgaaccgaacccgtaaaacgtacgaccaaacgtaacgtaaccgtaccgtaaggaacctacgtaacccgtaaccgtaaccaacgttaaacccggaaccgtaaaccgtaaaaacgtttaaccgaaacctaacgtaaacgtttactacggtaggaacgtaacgtaccgaaagtaccgtacctcgggttaccagttaccgtaggaacggtacccgtaacgggttccttaaccgtacgtttccggtaggtcgtaacggtagtaacttaacggttactaaataacggtacctattacccgttttaacccgttctacccgttacttacgttaccgttcgtaccggaacgttccgtaacccgggtaccgtccctaccggttccc

SEQ ID NO: 104933 - DNA, 838 bp, Homo sapiens
  misc_feature: GYAE6OF02IKEDN.17.34.D01.1.454.CMB.1.raw
  modified_base (256)..(256): a, c, t, g, unknown or other
  misc_feature (256)..(256): n is a, c, g, or t
tcagcgtagactagcacgaccggtgctcgatttagatcgtctgtgttggggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtggagggtctccgtgacgaaggtcttcgnggaggtccaccgttcacgacgtactattacgtttacgtaattggggtacgccggtaccgggtccttcgtacggtaaccgaacgggtcccgttttaggacggttagggtaacggtagggggaaaggtaccgttcccggttaccccgttaaagttccggttaacgaacccgtaaccgtaaaccccgtaaaaccgtaccgaccgtaacgtaaacggtaaccggttaccggaacggggtacaaacggtaccctaaccgaaacccgtaacggttaaaccccgggaccggtaaacctaaaacgtttaaacccggaaacctaaccgttaacgtttaaacgtcggttaagggaaactaccgttaacggaaaaccgtcggttacccttacgtacgtaactacgttaacggaacgggtaccgtaccgggtttaccttaccgttaacctttcgtaggttcggaacggtaggtaaacttaaaccgttactaacgtacctacgttccttaacctttacccttttaaccgtaccccgttccttaagtccctttaccgggtacggtccctaacggttaccccgggacccttacccgg

SEQ ID NO: 104934 - DNA, 770 bp, Homo sapiens
  misc_feature: GYAE6OF02GUX85.17.34.D01.1.454.CMB.1.raw
  modified_base (668)..(668): a, c, t, g, unknown or other
  misc_feature (668)..(668): n is a, c, g, or t
tcagcgtagactagcacgaccggtgctcgatttagatcgtctgtgttgggtttggggacaaaacaaccagattcctcctactaaagaagcccctgggagcacagctcatcaccatggactggacctggagttcctctttgtggtggcagcagctacgaggtgtccagtcccaggtccaggttggcgacaagtcgtaggggctggaggtaggaacgacgccgttgggtcctcgggtggacgggttctccgtaggctaacggcgtttcgtagggcggacctaccgttcgagccgtaactagtttaacggtttcaaggtttgggtcggaccggtaacccgggtccttccggttacggaacgttaacgggttcccgttaggaggttcgggacggtaggggtaacgggtactaccggtttaccctaggttccggttcaaccgtaaccgaacctaaaccgtaccggacctaaacggtaacgttaacggtaccgacgggactaaaccggccttaaccgaaccgtaaccgtaaccggaacgtaaacttaaaacgaaacgaacacgttaacgtttactacggtagtcgacttaacgactacgtcgtactacagttccgagacggtcgacgttcgttacttagtcgtaggtcaggttagtaattacttataacgtacncgttaccttacctttaccgtttcacccgttttcctacgttaacggttccgtacggtaccgttaccgttaccccgggtaccgttaccgtaacccgtttcccgg

SEQ ID NO: 104935 - DNA, 547 bp, Homo sapiens
  misc_feature: GYAE6OF02HQZ17.17.34.D01.1.454.CMB.1.raw
  modified_base (386)..(386): a, c, t, g, unknown or other
  misc_feature (386)..(386): n is a, c, g, or t
  modified_base (488)..(488): a, c, t, g, unknown or other
  misc_feature (488)..(488): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttgagtggatgggaaggatcgtccctagtcgttgacacaccaactacgcacagaagttccagggtcagactcaccataccgngacaaataacgaacacaagttaatcgtaggagctagaacgagcctgtcactctagagacgacgggtcttctacttcgtgtgcgaggagtaattactataacnctacgtcttccttttacacccttccttgtacttcgtcggtcctagtcggacccgtaccg

SEQ ID NO: 104936 - DNA, 849 bp, Homo sapiens
  misc_feature: GYAE6OF02ISFZ3.17.34.D01.1.454.CMB.1.raw
  modified_base (722)..(722): a, c, t, g, unknown or other
  misc_feature (722)..(722): n is a, c, g, or t
tcagcgtagactagcacgaccggtgctcgatttagatcgtctgtgttgggtttggggatcacaaaacaaccagattcctcctctaaagaagcccctgggagcacagctcctcaccatggactggacctggaggactcctctttcgttgggtggcagcagctaacgaagtcgacccactcccaggtcgacagtcgtggtgcaggtcgtggggctggagggtagaaaggaacgtccgtggggacctcgaggtagtaaggtcctccgtgaccgaggtcttcgtaggtactttctaacccgttttacctaccttaattaacggttactacgtaacgttggggtacgcccgtaccgtacgggccgtacgtacggaaaccgaacgtacctaggtagtagggtaggtagggtacgtacgggaacccgtaaaacccacgtacgggtacggttcgtaaccgaacgttaggttccttacccgttcctaaaccctacgggtccccgggtaaccgggaaccttaacgtaacccgttaaccgtaagtaccccgtaaccgtaaaccgtaacccttaccccgaaacctaaaacggtaaaccaaacggttcctaacccgtaaagttacgggttaaggtaccggttaagggaacgggtacctaaccggtaacttaaccgtacgtaacgaacggaaccggtaccgtaaccggttaccttaagtttacgtacggttacggnggtaaccgggttaaccacccgttaacggaacccggtttaggtccccgggaaagtacccgtaacccggacggttcgaacccgggtcccgtttaccggtttaaccggtcccggtttacgggaaccgggg

SEQ ID NO: 104937 - DNA, 686 bp, Homo sapiens
  misc_feature: GYAE6OF02GKS4I.17.34.D01.1.454.CMB.1.raw
  modified_base (331)..(331): a, c, t, g, unknown or other
  misc_feature (331)..(331): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctggcaaggtcttcgtggacggctaccttcagcgactatagtttacaagttggtgcgacgggtctcgtaggacaggtccttggagtggagtgggaagtntcgtcctatcgttgacacgacaaactcgcacagtacgtccgaggcaagactcaacactaaccgacggaactaaacgttaacgaacactaagttaaactacgtagggtacgacgtacgaaacgacgtaccctggtacctaacgtcgttaggaacggaccggtaccgggtacctttacgttaccttaccgttaggtaccggtacggtaacggttaacgttaaacttaaccgtaattaaccgtaacgttcgtaccttttaccgttttaacccgtaccccgtttaccttaccggttaccgtttccggtacggtacccgtacggttacccgggtacccccggttccgtacccgttacccg

SEQ ID NO: 104938 - DNA, 941 bp, Homo sapiens
  misc_feature: GYAE6OF02IU7LM.17.34.D01.1.454.CMB.1.raw
  modified_base (295)..(295): a, c, t, g, unknown or other
  misc_feature (295)..(295): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctccgtgcgaaggcttcgtggacggcaccgttcagcgacttatagttttaccaatttggggtcncggaccggggcctcgtagggaaccaacgggtccctttaggacggttagggtacgttagggggaacgggattcccggttacccgttaagttccggtttacggacctaaccgaaccctaaaacctaccggtaccaacgaaggtaaccgtttcccggaacggggtacctaaggtaacccgttaccgaaaccccgtaacgttaaaaccccgggaacccgggaaaaccgttaaaaaccggtttaaaaccgtaaacccggtaaaccgttaaacgggtttttaaaacctaccgggtttaacgggaaaccggtacgtttaaccgggtaaacccgtaacggttccccgttaacgttaccggtaacgtttaccgttaacgggaaccgggtaaacccggttacccggggtaccttttaacccgttaacccgtttcggttacggtaccgggacggttaacggggtaacctttaaaacgttaaccgtttaaaacgttaacccgtacgtttaccttaacccgtttttttacccctttttaaaccccggttaccccgtttaaccccgtttacgtttaccccgtttaccggttaccggggggttaccctaaccgggttaaccccgggtacccccggtttaccgtacccccgtttacccccgg

SEQ ID NO: 104939 - DNA, 912 bp, Homo sapiens
  misc_feature: GYAE6OF02HWBG4.17.34.D01.1.454.CMB.1.raw
  modified_base (266)..(266): a, c, t, g, unknown or other
  misc_feature (266)..(266): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccaggttggtgacaatcgtggggctggaggtgaagccgccgtgggtccgtcgggtggtacgggtcctcgtgacgaagggtcctttacgngggacggacctaccgttcgaacggccgaacttaattacggtttcaaacggtttggggtcgccgggtacggggtcccttcgtacggggaactaaaccgggtcctttagggtaggtcggggtaaggttacggggaaggtacgttacccggttcccgttaagtttaccgggtttacggaacctaaccgtaaaaccccgtaaaacgttacccgaccgtaaacgtaacgggtaaacgtttcccggaaacggggtacctaacggtaacctacccgaaacccgttaaaccgtaaaaccccggggtccgaaaacccttaaaaaggtttaaaacccgaaaccgttaaaacccgttaaaggttttaaacgtaccggtaagggtaacgacccggttaacgaaaccggtaactacccggttacgttaccctacgttaccggtaggaaaccgggtaccggtaaccgggtccctttacgttaccgtttcggtacggtccgggtacgggtaaagggttaaaccttaaagtttaacctaaacgttaacccgttacgtaccggtttaaccctttacccggtttttaaccacccctttacggtttaccgtaccgttccggttaccgggacccttaccggggtaccgtaacccccgggttacccg

SEQ ID NO: 104940 - DNA, 694 bp, Homo sapiens
  misc_feature: GYAE6OF02JVGWU.17.34.D01.1.454.CMB.1.raw
  modified_base (80)..(80): a, c, t, g, unknown or other
  misc_feature (80)..(80): n is a, c, g, or t
  modified_base (215)..(215): a, c, t, g, unknown or other
  misc_feature (215)..(215): n is a, c, g, or t
  modified_base (619)..(619): a, c, t, g, unknown or other
  misc_feature (619)..(619): n is a, c, g, or t
tcagcgtagactagcacgaccggtgctcgatttagatcgtctgtgttgggtttggggatcacaaacaccagattcctccncttttaaagaagcccctgggagcacagctcatcaccatggactggacctggagttctctttgtgtggcagctagctacgaggtgtcccagtcccaggtccaggttggtacgcaagtcgtgggctgaggtcgaaanccgaccgtgggtcctacggtagacggtctaccgtgaccaagggtcttcggagggacgtccctaccgttagacgtacgtacctaagttacgtttacgtaagttccggtaggcccgtacgggtcctcgtagaccgacggtcgtagagtcgagtagggacgtgttcccgcgtactggtacacgtacgaacctaaacgtcgactaagacgtacgttccgaggccagtaccacgtaccacggtacgacgtactaaataaccgactaacgtacgttataccgtacggtagtacgtaccgagtaccgtacgtacgcccgtaccgtcgtagtaaccgtaccgtaaccgggtaccttaccgtaccgtttcgtaggtacgtacggtaacggtacgtaagtaccgtagtaccgtntaccggttactttaccttaacgtacccgttcgtaccgtacgttccggaacgtcccgtacgtacccggtcctaccg

SEQ ID NO: 104941 - DNA, 651 bp, Homo sapiens
  misc_feature: GYAE6OF02JA7FX.17.34.D01.1.454.CMB.1.raw
  modified_base (162)..(162): a, c, t, g, unknown or other
  misc_feature (162)..(162): n is a, c, g, or t
  modified_base (265)..(265): a, c, t, g, unknown or other
  misc_feature (265)..(265): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggagttctctttgtggtgcagcagctacaggtntccagtcccaggtccagttgtgcaatcgtgggctgaggtgaagacgccgtgggtcctcggtgagggtctccgtgcaaggtcttacgtggacggactaccgttnacgcgactacgttagttactaagttcgggtgcgtacgggccttgcggaactaaggtccttgaggtggaagtggaagactcgtaccctagtcggtcaacgtaaccaaccgtaaactacgacaacgagtaacgttccgagggacagtacctacaaccgacgttaacggaccgaaactaaacgttaaccgaaacgtaactaagttaaacgtactaggactacgacgtaacgacgtccttagtacagttacgagtacggactaacggtcctttacacgtttccgagtccgtagacgtaataactagtaactatacgtgtaaccgttccttacgtacccgtaccttgtaaccgttcggtaggtacccgtagttacccgggacccgtacccg

SEQ ID NO: 104942 - DNA, 685 bp, Homo sapiens
  misc_feature: GYAE6OF02IWTZH.17.34.D01.1.454.CMB.1.raw
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (406)..(406): a, c, t, g, unknown or other
  misc_feature (406)..(406): n is a, c, g, or t
tcagcgtagactagcacgaccggtgctcgatttagatcgtctgtgttggggtttggggatcacaaaacaaccagtattcctcctctaaagaagccccgtgggagcacagctcatcaccatggactggacctggagttcctctttgtggtggcagcagctacgaggtctccagtacccgaggtccaggttggtgcaatcgtggggctgaggtgaagaccgcctgggtaccctcggtgacggtctccgtagcaaaggtcttcgtgggagcctaccttcagcgactatagtttcaagttgggtncgacggcctnggacaaggccttgagtcggnttggggaacgatccgtccctaagtcgttgaactacgacaaacgtacgcaagaagaacgtccagggtcaacgtacncaaccaagtaaccgacgaacaaaaattaaccgaaacaactaggtaatcgtcggacgcttaggaacctacgcgttaggtactaacgttccgtaagggtaccggaacgtacccgggttctttaccgttaaccgttccgtgttaccggagaaggtaaacttaacgttaaccttaatacccttagtcgtccctttaacccgttttaccaacccccttttacgtttccggtaacctttccgggtaccggtacctaccgggttacccggtaacccccgttcccgg

SEQ ID NO: 104943 - DNA, 816 bp, Homo sapiens
  misc_feature: GYAE6OF02HO51R.17.34.D01.1.454.CMB.1.raw
  modified_base (143)..(143): a, c, t, g, unknown or other
  misc_feature (143)..(143): n is a, c, g, or t
  modified_base (158)..(158): a, c, t, g, unknown or other
  misc_feature (158)..(158): n is a, c, g, or t
tcagcgtagactagcacgaccggtgctcgatttagatcgtctgtgtttgggtttggggacaaaacaaccagattcctcctactaaagaagcccctgggagcacagctcatcaccatggactggacctggaggttcctctttgnggtgcagcagctaanaggtacgtccgagtcccgaggtccagttggtgactatcgtgggctgagtgaagacgcgtggtacctggtgtggtctcgtacgacgaaggtccttacgtggacgtaccgtaccgttacgacgtacgtaacgttagttacgttacgtaaggttcgggtacggaccggtaccgggtaccgtacgtaacggtaaccgtaacggtacgtaggtaggtaggaggtaggtaaggtacgtaccgtaccgttacggttacgtaacgaaccgtaaccaaaccgtaaaccgtaccgtaacgaacgtaacggtaaccggttaccggaacggaccaaccgtaacgtaacccgaaccgtaaaccgtaaccggaaaccggtaaacgtaaaaaccgtaacgtaaacgtaaacgttaacgttaacgtacggtaaggtaacgtaaccgtaacgtaaacgtaccggtacgtaacgtaacttaacggtacgtaacggtacggtaaccgtacggtacgttaacttacgttacgtaggtacgtaggtaacgttaagttaactaacgtaacgtaacttaccgttacgttaccctttaccgttacccgttaccttaccgttacgttaccgttacggtacgtaccggtacccgtacccggtaacccgtccgttacccgtaccg

SEQ ID NO: 104944 - DNA, 726 bp, Homo sapiens
  misc_feature: GYAE6OF02JELGH.17.34.D01.1.454.CMB.1.raw
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
  modified_base (507)..(507): a, c, t, g, unknown or other
  misc_feature (507)..(507): n is a, c, g, or t
  modified_base (539)..(539): a, c, t, g, unknown or other
  misc_feature (539)..(539): n is a, c, g, or t
tcagcgtagactagcacgaccggtgctcgatttagatcgtctgtgttgggttgggacaaaacaaccagattcctctctaaagaacgcccctagggacgcacagctcatcaccatggactgacgtgacggttcctctttgtggtacgtcaggcagtctacgaggtcgtaccacgttacccgaaggttccctaggtttcggtacgacgtaagttccggtggggccttagggaacgggtgaaacgccggtccgtgggtacctacgggtcgtacgggtccttacgtgtacgaacggtcttcgtaggacggtactaccgttgagtacgttaagttacgttacgtttcgtaaagtttgggtcgaccggtacgggtacccttcgtaacggggactaacgggtccttggaaggtacgtaaggtacggaacgtctaccggttactacggtcgtacggacctacctaaacgactcncgaacgaagtcgtacgcgacacncgtacacgataccggaanaactaaagacgacacgtatacgtgtagacgtnacgacgtgtcctcgtaccagtagtagacgacgcgttctacgtcgttcgtacgtgtaccgagtaacgttacgttacttaagaccgtacgttacgttactttacccgttaccttacccgttcgtaccgttaccgttacgtccggtaaccgtcccgttaaccggtccccgtaccgttcccggttaacccg

SEQ ID NO: 104945 - DNA, 592 bp, Homo sapiens
  misc_feature: GYAE6OF02HCBUE.17.34.D01.1.454.CMB.1.raw
  modified_base (194)..(194): a, c, t, g, unknown or other
  misc_feature (194)..(194): n is a, c, g, or t
  modified_base (227)..(227): a, c, t, g, unknown or other
  misc_feature (227)..(227): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
  modified_base (478)..(478): a, c, t, g, unknown or other
  misc_feature (478)..(478): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgnggggctggaggtgagacgctgggtcctcggtgngggtctcgtgcaggcttcgtggacggccaccttcaggccgactagtagtttcaagttgggtgcggacgggcctcgtggactaaggtccttggagtggagtggggaagacgtcgtccctagtcgttgacaacaccaaactacgcacagacgtcgaggtcagctcacacgtaccgcgaactaagtaacgaacacgtaagttatcgtaganctanaancgcttgcatcngacgacgcggcttcgttactcgtgngacgtaggattaacgtactaagtactacgtcgttacctttaccctttacctacccttcccgttacgttaccgtttacggccgggtacctacggtacccggtaacccggttaccc

SEQ ID NO: 104946 - DNA, 767 bp, Homo sapiens
  misc_feature: GYAE6OF02JUC6M.17.34.D01.1.454.CMB.1.raw
  modified_base (320)..(320): a, c, t, g, unknown or other
  misc_feature (320)..(320): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagctagactacgtaggtcgtccacgtcccgtaggtccctgttggtgaccgtaacgtcggttggggctggaggtgaacgccgccgttcgggtcctcgggtagacggttcctcgtgctagggtcttcgtggacgcctaccttcgagcctactagttgttacgagttgggacncggtacggcctcgtaggacgacggtccgttgtaggtcggagttcgggaaacgtcgtaccgtccgtagttacggttacgaccaacctaaccgaactcgacaacacggttacgtaccgaggactacgactactaccgaaacgtaccgacgtaaacctaaacgtaacgtaacctactaacgtaacgtacgtaggtacgtaccgtagaacgtaccgtacgtgtaccgtactaccgtacgtaccggacgtaccggttacgttaccgttaccgttacgttacggtacggtaaccggtaccggttaaagttaaccgtttaacgtaaccgttacgttaccgttacggttacccttttacccggtttaccctttaccccgttacgtttaacccgttcggtttaccggttaccgggttaccccttaccgggttaccccggtaacccccggttaccgg

SEQ ID NO: 104947 - DNA, 1015 bp, Homo sapiens
  misc_feature: GYAE6OF02HX6JJ.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttctctttgtggtggcagcagctacaggtgtccagtcccaggtccagttggtgcaatcgtggggctgaggtgaagacgccgtgggtcctgggtggagggtcctccgtgacgaacggtcttcgtgggacgcctaccttcgagccgtactaattagtttccgaagttggggtcgtaccggaccgggtccttccggtaggaaccgtaacgggtcccgtttagggacggtacgggtaggttacgggggaaacggtacgttaccggttacccccgttaaggtttccggtttacggaacccgtaacccgtaaaacccgtaaaaccgtttaacccggaccgtaaaccgtaaacgggtaaacggtttaccccgggaaacggggtcctaaacgggtaaccccttaaccgtaaacccccgaaaccggtttaaaacccccggggaaccggaaaaacccgtttaaaaaaccggtttaaaacccggaaaacccgtaaaccggtttaaaacggttttaaaacgttacccggttaaaggggtaccgttaaacggtaaccggtaaaaccgtaaccggtaaccgttaccggttaacgtaaacccggttaaccggggaaaccgggtaacccggttaaccggggttacctttaaccggtttaacccgttttacggttacgggttacggtaaccgggtaaacgggttaaacgttttaaacgtttaaaccgttaaacgtaacccgttaccgtttacggtttaaccccttttaacccttttttaaccccggtaccccgttttaccccggtttaccggttaccgtttaacccgggttaccggggttaacccgttaacccgggtttaaccccggggttaacccccggttaccccgttaacccccgg

SEQ ID NO: 104948 - DNA, 775 bp, Homo sapiens
  misc_feature: GYAE6OF02II66J.17.34.D01.1.454.CMB.1.raw
  modified_base (189)..(189): a, c, t, g, unknown or other
  misc_feature (189)..(189): n is a, c, g, or t
  modified_base (656)..(656): a, c, t, g, unknown or other
  misc_feature (656)..(656): n is a, c, g, or t
tcagcgtagactagcacgaccggtgctcgatttagatcgtctgtgttgggtttggggacaaaacaaccagattcctcctctaaaagaagcccctgggagcacagctcatcaccatggactggacctggaggttcctctttggtggtggcagcagctacaggtgtccagtcccaggtcctagttggtganaatcgtggggctggaggtgaagcgccgtgggtcctcgggtagacgggtctccgtagcgaacggtcttcgtagggacggtcctaccgtttcgaggtccgtaaccttaagttagtttacgaaagtttggggtcgccggtcgggccttaccgtgggacgaaacggtccgttagtaggtcggtaacgtagggggaacgtacttaccgttccgttaacgttcgttacggaaccgaaaccctaaccgaaacgttaacgacgaaaccgtaaggtaacgttaccgaacgggtcaacgtaaaccgtaacccgaaccgtaaaccgtaaacccggacggtaaaaccgtaaaacgtttaaaaccgaaacgtaaccgtaaagttaaacgtaccgttaggaacgtacgtacgaaacgtatcccgttgacctagtacgacggaagcccgtaacgtcgtttacgtaccgttagtcggtacggngtaacgtaacttaagtaaccgtaacacttacgtacgtacttttccgttacctaccgtttccgtacgtttacgtaccggttcggaccgtacggttacccgaacccggttcctagttcccc

SEQ ID NO: 104949 - DNA, 777 bp, Homo sapiens
  misc_feature: GYAE6OF02GLHQ6.17.34.D01.1.454.CMB.1.raw
  modified_base (141)..(141): a, c, t, g, unknown or other
  misc_feature (141)..(141): n is a, c, g, or t
  modified_base (474)..(474): a, c, t, g, unknown or other
  misc_feature (474)..(474): n is a, c, g, or t
tcagcgtagactagcacgaccggtgctcgatttagatcgtctgtgttgggtttggggacaaaacaaccagattcctcctctaaagagcccctgggagcacagctcatcaccatggactggacctggacggttcctctttgnggtggcagcagctacgtaggtcgtccagtcccgaggtcctaggttcgggcacgaacgttcggtcggggtactggaagggttcaaacggccggttccgttcggggtcccgttacgggcgtaccgggttctccgttacggacgtaagggttccttacggacgggacggccttaacccgttgacgtacggtacttagtacgttctagttgggtcgacggtaccggctcgtacggactacggtctagaggtcgaggtagggactacgtccgtactacgtcggttacaacgacgtaaacctaacgaccgtacactaacggtacgtacggaccggttanacccgtactacgacctaaccggtaccggaaccgtaaaccttaaaccgtttaagacccgtaacggtaacgtttacgtacggtacggtaacgtacgtaaacgaaccggttaccgtactacggtattaccggacgttaacgacgggacgttacggtacgttacgtccgtagtccgtagaccggtaagtacgtactaacgtacttacgaccgttcgttacctttaccgtacccttaccttacccggttaactcggttaccgtacggtacccgttaggaccccggtacccttaccgtaccctaaccgg

SEQ ID NO: 104950 - DNA, 888 bp, Homo sapiens
  misc_feature: GYAE6OF02FS16Y.17.34.D01.1.454.CMB.1.raw
tcagcgtagactagcacgaccggtgctcgatttagatcgtctgtgttgggtttgggacaaaacaaccagatttcctcctctaaagaagcccctgggagcacagctcatcaccatggactggacctggaggttcctctttggtggtggcagcagctacgaggtcgtccacgtcccgaggtccagttggtcgcaatcgtggggctggaggtagaacggtacgccgttgggtcctcgggtggacgggttcctccgtgacgtaggtcttcggtggacgtcctaccgtttacacggcgtacgttagttacgtttacgtaacgttggggtcgccggtaccggtccgttcggtagggaaccgtaacggtcctttacgggaggttcggacggtagggggtaacggtcgtcccgttaccggtacgttcggttacgtaccaaccgtaacctaacgtccgacaaacgtaaggtaccgttaccggagggtaccacgggtaacctaacccgtaaacccgtaacgtaaccccggaaccgttaaaaacgttaaaacccgttaaaaccgaaaccgtaaaccgtaaagtttaaccgttacggtaaaccgggtattacccggtaacgaaaccggtacgttacccgtacgttacgtacgttaccgtacggtaaccgggaccggtacggtttccgtttaacgtttaaccttcggttcgggtacggtacgggttaacgtaaacgtttaacttaaaccgttaaagtaacccgttaccgttaccggtttccctttaacccgtttttacccgtaaccccttttcccgttaccggtttaacggttcccgggtaccggttaaccgtacccgggttaccccgtacccccgggttaccgttaacccggttaccccg

SEQ ID NO: 104951 - DNA, 990 bp, Homo sapiens
  misc_feature: GYAE6OF02IDYWT.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatcggactggacctggacgttcctctttgtggtggcagcagctacaggtctccacgtcccaggtcctagttggtgacctaagttcgtgggctggaggtagaacgcgtccgtagggtcccttaggtcggacgggttcctccgtgacgaacggttccttgtacgggactcccgtaccttaccgagaccgtacgttaacttacgtttacgtaagttcgggtacgtacccggtacgggtcccttacggtacggaacggtaaccgggttccgtttaacgggtacgggttaacgggtacggttaacggggtaaacggtaccggttaccccgtttacccgtaaggttcccggttaacggtaacccctaacccggtaaaacccgtaaacggttaaccccggaaccgttaaccggtaaacgggttaaacccgttaccggaaaccgggttacccgaaacgttacccgtaaacccggtaaaccctaaaccggttaaaaccccggaaaccggtaaacccgttaaaaacgtttaaaaccggtaaacccgtaaaaccgttaaaccggttttaaacgtaaccggttaacggtaaccgtaaccggttaaccgttaaaaccggtacgttaacccgttaaccgttaaccgtaacgttaccgttacgggtaaaccggtaaccgttaaccgggttactttaccgttacgttaccggttacggttaccggtaacggttaacggttaaacgttaaccgttaacgttaacgtaaccgttaaccgttacggtttaacccttttaacccgtttaaccgtacccccgttttagttacccgttaccgttcgttaacccgggttacccttaaccgggtaccccgggttacccgttacccccgg

SEQ ID NO: 104952 - DNA, 982 bp, Homo sapiens
  misc_feature: GYAE6OF02JI7XB.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggactggacggttcctctttggtggtggcagcagtctacgaggtcgtcccaagtcccgaggtcccaggttaggtcgctaagtccgtggggaccttggagggtagaacggtaccggtcccggttggggttcccttcggggtacggtacgggggttccttcccgttaggaccgtaaacgggtcctttacggtacggggaacggtcccttaaccgttacggaacggtccgtaacgttaacgttacggttttacgaaggtttcggggttacggccggtaaccgggttccttacggacgggtaaccgtaacggggttcccttgggaacggtagggtaacggtagggggtaaaaccgtcgttacccggttacccgttaacgttcccggttagtaaacccgtaaccgtaacctaaaaccgttccgacgaaacggtaacggttaaccgggttaccggaacggtaccgtaacggtaccttaaccgttaaaccccgaacggttaaacccggggtacgtaaaaccttaaaagtttaacccgaaacgtttaacgttaacggttttaaaccgtccggtaaggtaaccggacttaacgtaacggaaccctgtttaccggtataaccgttggaaacgtacggaacccggtttacggtacgtttaccctaacgtttccgggtaacggtacgggtaaacccgggtaacgttaaacggttactttaacgtaaacccgtttacgtcggttaccccgttttaacccgttttacccgttttaacccctaaccggtttttccccgttttaacggtttaccggggtaccggttaaccccgttacgggtttaacccccgttaccccggttacgttaacccccgg

SEQ ID NO: 104953 - DNA, 790 bp, Homo sapiens
  misc_feature: GYAE6OF02GCY5Y.17.34.D01.1.454.CMB.1.raw
tcagcgtagactagcacgaccggtgctcgatttagatcgtctgtgttgggtttggggacgaaaacaaccagattcctcctctaaagaagcccctgggagcacagctcatcaccatggactggacctggaggttcctctttggtggtggcagcagctacaggtgtccagtcccaggtccagttggtgcaatcgtgggctggaggtagaagacggcctgggtccgtggtgtaggggtctctggcaaggtcttcgtgggacggcctaaccgttcgagtccggaaccttagttaacgtttacctaaggtttggggtcggtcgggtaccggggcccgttacggttcgggaaccgaacggggtcctttgggaaggttgggacggttaggggaaggtatccgttacccggtattcggttacgaaccgaccgtaacctaaaaccgaacggtaccaacgtaagtaccgtttacgacggtacacgtaacaccgaacctaaccgtaacccggcggtaaacctaaaagttaaccggaacaacctaagtttaaacgtgtacggaagtcgaagaaccgacgacctagtactacaccgttggaacggtacgtaccggttccttacgttaagttccttaggtaggtaccgggaagttaaacgttaacgtttactaaacgttaaccagttaccggtccctttaccggttttaaccctaacctttaccccggtttaccttaacggttccggtaccgggtccgttaccggtaacccggggttaacccccgtacggtccccttaccccgg

SEQ ID NO: 104954 - DNA, 913 bp, Homo sapiens
  misc_feature: GYAE6OF02FT6SB.17.34.D01.1.454.CMB.1.raw
tcagcgtagactagcacgaccggtgctcgatttagatcgtctgtgttgggtttggggatcacaaacaaccagattcctcctctaaagaagcccctgggagcacagctcatcaccatgactgactgagttctcttgtggtggcagcagctacaggtgtcacgtcccaggtccagttggtgacgaatcgtggggcctggaggtgaaggacgccgtggggtccctcgggtaggtacggggtccttcccgtaggaccgtaaagggcttttccgtagggtacggaccgtaacctttcgaccgtacggaacccgttaagttacggttttaccaaaagttttcgggggttagtacccggtaaccggggtacccgttccgttaggggaacccgtaaggtaccccggttttgacgggttagggtaatcggggaaagggtacgttccggttaccccgttaagttacggtttaccggtaaccggtacctaaacccgaaaccggttaacccggtaccttaaacccggaaggtaaaccgggtttttaccccgaacgggggttccaaacggggttaaccctaccgtaaccccgtaaaaccgttaacccgggtaccgggtaaaccgttaaaaacgttaaccggttaaaaccgaaaccgttaacggttaaaccgtttacgtacgggtacgaagttaccgtaaacgacggtaccttacggtacttaactccgttaaggacgggtaacgtaaccgggttactacccggttaaaccttcgttaacgttcggacggtaccgggtaaagttagtttaaacgtcgttaaaccgccgtaggttacccggttacctttttaacccgaacccttttacccgtataccgtttaccggtaccggttacgtacgttacccgggtacccgggtttaaacccg

SEQ ID NO: 104955 - DNA, 747 bp, Homo sapiens
  misc_feature: GYAE6OF02GZHJ6.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccagttggtgcaatcgtggggctgaggtgaagacgccgtcgggtcctcggtgacgggtcctccgtgacgaaggtccttcgtgggacggcctaccttcgagcgtacttagttagtttcaagtttgggcgaccggacgggtcctcgtcggacgtaacggtccgttaggaggtcggtaggtagggaagtcgtaccgtcctagttcgtacgaaccacaacctaaaccgtacgacctaacgaacgtaacgttaccggaaggtctaacgtactaccgaacccgtaacgtaacccggaccgtaaacctaaacggtaaacccgaaactaacctaaaggttaaactcggtaacggtacgtacgttaacggaaactaccggtaaccgttacggtacccttaagtaccggtacgggtaaccggtaaccggtaccggttacctttaccgttaccgtttgtacggtacgtacggtaagttaacgttaaacttacgaacgttactacgtaccgttcttacccgtttacctacccttcgttacctacgttcggtcgtaccctacggtacccggtacccgttccg

SEQ ID NO: 104956 - DNA, 649 bp, Homo sapiens
  misc_feature: GYAE6OF02FNPW4.17.34.D01.1.454.CMB.1.raw
  modified_base (499)..(499): a, c, t, g, unknown or other
  misc_feature (499)..(499): n is a, c, g, or t
  modified_base (583)..(583): a, c, t, g, unknown or other
  misc_feature (583)..(583): n is a, c, g, or t
tcagcgtagactagcacgaccggtgctcgatttagatcgtctgtgttgggtttggggatcacaaaacaaccagattccctcctctaaagaagcccctgggagcacagctcatcaccatggactggacctggacggttcctctttgtggtggcagcagctacaggtgtccagtcccaggtccaggttggtgcaatcgtggggctggaggtgaagcgccgtgggtcctcggtgaggttctccgtgcaggtcttcgtggacgcctaccttgacgtcgtacttagttagtttcaagtttggggacgccggacgggtcctcgtggaacgaacggtccttggaggtggacgtgggaagtctcgtcctatccggtgtacactaaccgaacctacgctacaacgtacgttccgagggaccagtacctaccgtaccaacgtaaacccgcggtaaactaaagttaaaccgaactacgtaaagttaactcgtaggacgtactacgaaacncgacgttcgacttagtccgtagtacggacctaccgggtcttacgtccttgttcgtaggtcgaaggtactagttacctataccgntactccgtttaactttccaccgttcctagtccgttcgccgggtactcggtaccgttacccgtaccg

SEQ ID NO: 104957 - DNA, 721 bp, Homo sapiens
  misc_feature: GYAE6OF02IYF60.17.34.D01.1.454.CMB.1.raw
  modified_base (221)..(221): a, c, t, g, unknown or other
  misc_feature (221)..(221): n is a, c, g, or t
  modified_base (381)..(381): a, c, t, g, unknown or other
  misc_feature (381)..(381): n is a, c, g, or t
  modified_base (514)..(514): a, c, t, g, unknown or other
  misc_feature (514)..(514): n is a, c, g, or t
tcagcgtagactagcacgaccggtgctcgatttagatcgtctgtgttgggtttgggggatcacaaaacaaccagattccctcctctaaaagaagccccctggggagcacagtcctcatcaccatggactggacctggacggtttcctctttggtggtgggcaggcagctacaggtgtccagtcccaggtccagttggtgtagtcgtggggctgaggtgaanagcctggggcctggtgagggtctcctgcaaggcttctggagccaccttcagcgtataattagttcaagttgggtgcggacggcctcgtggaacaaggtccttggacggtggagtgggaaggatccgtccctatcgttagacctacaacctaaaagtccgnaacaggaaacgttccaagggacaacgtacctaacaacctaagaaacccgacggaaaccaaaaattaaaccgaaactaaccaaaggttaactacgtaggaacagtagaaacgaacgtccttagtacaagttacnggaaacggaccgaacgggtcttaacttaaccgttctcggtgaccgaaagggtaacttaaacttaaactaagtaacctactcggtttaccctttaacccgtttttaacctaacccctttccccgtttagttaacccgttttccggtaacggggtaccccttaaggtttaaccccggggttaacccccccggtaccttaaccccccggg

SEQ ID NO: 104958 - DNA, 812 bp, Homo sapiens
  misc_feature: GYAE6OF02GCK68.17.34.D01.1.454.CMB.1.raw
  modified_base (164)..(164): a, c, t, g, unknown or other
  misc_feature (164)..(164): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtntccagtcccaggtccagttggtgcaatcgtggggctgaggtgaagacgcctgggtcctcggtgagggtctcctgcaaggtcttcgtggcggcaccttcagcgactatagtttcaagttgggtcgcgacgggtcctcgtggaccgaaggtcccttggtaggtggagtagggggaaggtacgtccggtaccctagtccggtttagaacctacctaacctaaacctaccggacctaacgaacgtaacggtttaccaacggggacaacgtaaccgtaccaaacccgaacgttaaaccccggaccggtaaactaaaacgtttaaaccgaaaaccgtaaacgtaaacggttaaacgttaccggtacgggtaacgtaccgttacgaaaccgtacggtaccttcggtacctacgttaccgtacggtacgggtaacctacggggttcctttacgttacccgtttcgttacgggttaccggacggttaaccggtaaaggtttaaactttaaccgtaaactttacctaacggttcggttacccttttaacccgttttttaaccgtaaccccgttttaccccgtttacggttacccgttttccggggtaccggttacccgtaaccgggtttaccccgggttaacccccggttacccccgg

SEQ ID NO: 104959 - DNA, 787 bp, Homo sapiens
  misc_feature: GYAE6OF02HF3MW.17.34.D01.1.454.CMB.1.raw
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (335)..(335): a, c, t, g, unknown or other
  misc_feature (335)..(335): n is a, c, g, or t
tcagcgtagactagcacgaccggtgctcgatttagatcgtctgtgttgggtttggggatcacaaaacaaccagattcctcctctaaagaagcccctgggagcacagctcatcaccatgactggacctggagtcctcttgtggtggcagcagctacaggtgtccacgtcccaggtcctagttggtgctaagtctggggctggacggtgaacgaccgcctcgggtcctcagtaggaggtctcctgacgaggtcttntggattactacgttacctcctatagtntactaacgtgggtgcgtccgaggccgctaggaaccaccgacctgtaggtacggnggtacgggtaggcgggaaccgtaaccctaacacgttggtactacacgtagtacgtccttccgacctacgtcccgtaccggacgacgtacctaccaacctactaccgaccctaaccgaaccctaccctaacccgtaaaacaaacccgaccgtaacccgtaccgttaacgaagttacgggtaagtttcgggaacgggtacccgtaacctaccgaacctaagtcccgttacgaacccgtaaccggtaccccggttacccgttaccgttttaaccggttaacgttcccgggttaacgtaaccgggggtaaccctaaacccgggttaccccgtaaccggtaaccggttaccccggggttacgaacccggggttacccggtaccgggttacgaacccgggtccgggttaacccgttttccgggtacccggtttccggggacccggggttaccccgggg

SEQ ID NO: 104960 - DNA, 888 bp, Homo sapiens
  misc_feature: GYAE6OF02FKQEZ.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttcgtggtggcagacagctacaggtgtccagtcccgaggtccagttggtgcaatcgtgggctgaggtgaagacgcgtcgggtccgtcggtgacgggttctccgtgacgaacggtccttcgtggacggtctaccttcgacgacgtactagttacgttttcgaagttggggtacgtccgggaccgggccttcgtagggacgtaacggtcccttaggacggtggaaggttaggggaacggtactccggttaccctaagttccggttacgaaccgaaccctaaccgtaaaaccgtacgaacccgaacgtaacggtaacggtttaccgaacggggtacctaaaggtaccctaaccgaaaccgtaaaccggttaaacccggaacccgggtaaacctaaaaacggttaaacccggaaactaacccgtttaaacgtaaaccgtttacggtaacggacgtaaccgtaacgtaaaccgtaccgttaccgtcggttaacctaacgtccgttaacgggacgtaaccgtcgggtacctttaccgtttacgtaccggtttacgtacgggtaccggtaacggttaaacgtttaaacttaaccgttaaacgtaaaccgttaccgtttaccgttacccgtttaaccggtttttaacccaaccccttttaacccgtttcggttaaccccgttttagggtacccgggttaccgttaaaccgggttaccccgggttaacccccggttacccggtacccggtttacccccgg

SEQ ID NO: 104961 - DNA, 849 bp, Homo sapiens
  misc_feature: GYAE6OF02FSJKP.17.34.D01.1.454.CMB.1.raw
  modified_base (275)..(275): a, c, t, g, unknown or other
  misc_feature (275)..(275): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggcctggacggttcctctttgtggtggcgagcagctacgaggtgtccacgtcccaggtccagttggtgctaatcgtggggctggaggtgaagacgcgtcgggttcctcgggtgacggtcctccgtgcgacgtcgttcgtggacggctaccttnacggctaaccttagttacgtttcgaaggttttgggcggtccggtaccgggtccttcggtacgggaacctaacggggttccctttaggggaagggtttcgggtaagggttacgggggtaaaacgggtcctttccccgggttacccgttaagttttccgggttacgtaccgaaaccctaaaacccgtaaaaccgttaccgaccgtaaaccggtaacggtaacccggtttaccggaacggggaacctaaacgtacccgtaaccctaaccccggtaaccggttaaacccgggaaccggtaaaaccgttaaaacgtttaaacccggaaaccgtaaaccgtaagtttaaaccgttacggtacggtaaccgtaacgttaccgaaacgtaccgtacgttacgaccgttacgttccgtaacggtacgaccgtacgggttaccttacgttacgttccgtggtacgagttaacgtaacgttaacttacgttaacaccttacgtacgttcctttaccgtttacccttacccttccgttacttaccgttcggtacggaccgttacgggtaccgtaccccggttaccg

SEQ ID NO: 104962 - DNA, 823 bp, Homo sapiens
  misc_feature: GYAE6OF02IAYWS.17.34.D01.1.454.CMB.1.raw
  modified_base (599)..(599): a, c, t, g, unknown or other
  misc_feature (599)..(599): n is a, c, g, or t
tcagcgtagactagcacgaccggtgctcgatttagatcgtctgtgttgggtttggggatcaacaaaacaaccagattcctcctactaaagaacgccccgtgggagcacagctcatcacatggactggactggacgttctctttgtggtgcagcagctacgaggtctccacgtccacggtccagttggtcgactaagtcgtggggctggacggtagaacgacgccgtcgggtccctcgggtggtacgggtcctcgtgactaacggtcttggtacggaggtcctacgttacgagtaccggtaactttagttacgtttacgaaggtttggggacgtcgggaaccggtcccttaggtacgggaaccgtaacgggttccgttagggtaacgggtagggttaaggtacggggtaacggttaccgttaccccggttaccgtttaaggtacccggtttaacggaaaccctaacccgtaaacctaaaaccggttaccgaaccgtaacgtaaacgggttaaccgtaccgaacgggtacaaccgtccgtaaaccaacgtaaccgtacggaacgtaaactaaacgtaaaccgaactaacgtaacgttaacncggtaggaacgtactaacggaagtcgtaccgttacgtactgtacgtcgaacggtacgtacgttaacttcgtaccgtttcgtagggtcgtaaacgggtacgttaaacgtaactttaacgtaaccgaccgtttcccgtaccgtttaacctttaccccgtttcttaacccctttacggcgttttaccgttacggtccggaccttaccggttacccggtcccctaacg

SEQ ID NO: 104963 - DNA, 775 bp, Homo sapiens
  misc_feature: GYAE6OF02FKIL8.17.34.D01.1.454.CMB.1.raw
  modified_base (140)..(140): a, c, t, g, unknown or other
  misc_feature (140)..(140): n is a, c, g, or t
tcagcgtagactagcacgaccggtgctcgatttagatcgtctgtgttgggtttggggatcacaaaacaaccagattcctcctctaaagaagccccctgggagcacagctcatcaccatggactggacctggagttccctntttgtggtgcagcagctaacaggtgtaccagtcccaggtccagttggtgacaatcgtggggctaggaggtgaagccgccgttcgggtcctcgggtgacggttcctccgtgaccaagtcttacggcggaggtcctaccgttcgagaccgtacgtacttacgtttcgaagttttcggggcgtaccggaccggtccttacgtacggtaactaacgggtcttggacggttggagtacggggaagtcctccgttacctagttaccgtacgacctaacctaaccgtaacctaccgtacaaccgtaagtaccgttaccgacgggtactacggaccctacgaaccgtacgtaacccggcgtaaaactaaccgttaaccgaactaccggttaattaaccgtacgtgtaaccgtacgtaacgacgtaacggtctcgtacctacgtacgtacggaacggtacccggaggttaccttaccgtttaacgtaccgtttgaccgggtacggtaaacgttaaacttaagttaccgttaaccgattaccgttaccttacccggttttaccttaaaccccgtcccgtttaaccgtacgttacggttaccggttaccgtcccggtaccgtacccgggttaccccgtaaccccgg

SEQ ID NO: 104964 - DNA, 1010 bp, Homo sapiens
  misc_feature: GYAE6OF02I3EI4.17.34.D01.1.454.CMB.1.raw
  modified_base (141)..(141): a, c, t, g, unknown or other
  misc_feature (141)..(141): n is a, c, g, or t
  modified_base (223)..(223): a, c, t, g, unknown or other
  misc_feature (223)..(223): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgnggtggcagcgagctacaggtgtccagtcccaggtccagttggtgcaatcgtgggtctcggaggtgaagcgtcctagggtccncggtgagggtcctccgtgaccgtaaggtccttcgtagggaccggtctaacccgttcgacgtaccgtaaccgttatttaacgtttacgaacgtttcggggtacggtaccggtaaccggggtcctcggtaacgggtaccgtaaagggttaccccgttagggtaaggttacggggtaacggttacgggggtaaacggtaaccgtttccggttaacccccgttaaggtttaccgggttaacggtaaccgtaaaccgtaaacccgtaaaaaccggttaccgaccggtaaaccgtaaaggttaaaccgggttttacccccggaaagggggttaccctaaaacgggtaccccgttaaccggttaaaccccggtaaacccgtttaaaaccccgggaccggttaaaaaccggtaaaaccgttaaaaccggtaaacccgtaaaccgttaaaacggtttaaaacggtacccgttaacggggtaaaccgacgtttaaacgggtaaacccggtacggttaaccccgtagttaaccgttaacgtttacgtaacgggtaaaccggtaacggttaaccgggttacgttaacccttaacgttaccggttaccgtaccggggtaaccgtaaacggggttaaccgtttaaaacggtttaccttaaacgggtaaccgttacgttaccgttaaccgttttacccggtttaaaccgtaacccgtttcccgttaaccgtttacccggtacggttaccgggacctttaaccggtccggggtaaacccccttaccgggttacttacccccgg

SEQ ID NO: 104965 - DNA, 773 bp, Homo sapiens
  misc_feature: GYAE6OF02I5HK5.17.34.D01.1.454.CMB.1.raw
  modified_base (163)..(163): a, c, t, g, unknown or other
  misc_feature (163)..(163): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (331)..(331): a, c, t, g, unknown or other
  misc_feature (331)..(331): n is a, c, g, or t
  modified_base (641)..(641): a, c, t, g, unknown or other
  misc_feature (641)..(641): n is a, c, g, or t
  modified_base (679)..(679): a, c, t, g, unknown or other
  misc_feature (679)..(679): n is a, c, g, or t
tcagcgtagactagcacgaccggtgctcgatttagatcgtctgtgttgggtttggggatcaacaaaacaaccagattcctcctctaaaagaacgccctgggagcacagctcatcaccatggactggacctggtaggttcctctttgtgggtggcagcagctanaacgtcgcccaacttccccgaggtgcagcgtgggtncagtcgngggctgaggtgaagaacgcctcggggtcctnaggtacgacgttcctccnggacgtaaggtcctttacnggtacttccgtaacggtttaccgttctacgttagtacgtaacgtacggtcgggtacncgggtccacgggcccgtacgtacgggaaacctaaacggtccgtagggtaacgtgggtaaggtacggggtacggtagggggaaccccgtaaaaccctaaaccggagttttacggggtagttaaccgacggtacgtttttacgggacccctttaaccgaccccgttacggtacccgttaccgggaaccgttacgtaaccctaacgtacctaccggaaccgtaaccggtaaccccttacctaacctaaacgtaaaccgaactaacgggacctaacgtaacggtggtaacgtttacgggaacggttacacgtanactacggtactacgaccgtacgcgtaccgtactacttncggtcgagacgtacgtacccgtacgtaaccggtcgtacggtaacgtccgacgggtccgtcggccggttaccggttactcggttccggtacgggg

SEQ ID NO: 104966 - DNA, 946 bp, Homo sapiens
  misc_feature: GYAE6OF02IQQYB.17.34.D01.1.454.CMB.1.raw
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtaggcagcagctacgaggtcgtccagtcccaggtcctaggttggtcgacaatcgtggggctggacggtaggaacgaccggcgttcggggtccttcgggtaggtacgggtccttccgtagaccgtaacggtcgtttacgtagggacggtacctaaccgttcgaaggtccgtaaccgtttaagttaacgtttaccggtaaaggtttgggggtacggaccggggtaaccgggtccccgttaacggttacggggaaaccgtaaaccggggttcccgttacgggttaagggttacggggaaagggttttaacggggaaacgggttccgttaaccccggttttaccccggttaagggtttaccgggtttaaacccgaaccgggtaaacccccttaaaaaccccgttaaaaccggttaaccccggtaaccgaaaaccgtaacccgggttaaaacggtttacccggggaacggggttaaccctaaacgggtacccgtaaacccgtaacccgtaacggtttaaaacccgggaccggtaaaaacgttaaaaaccgtttaccggaaaacgtaacgtaacgtttaacgtacgggtagtacgacgtaacgaacgtacgtaccgtagtaccgttagtaccggtagaaccggtaccggtaacggtccttaaccgttagtccgttacggacgaacggtacgttaattaaacgttactaacgttaacgacctgttaacccgtttcctttaactacccgttaccgtcgttaccgtaccggtacgtacccggttctacccgggtacccctagtcccgtaccg

SEQ ID NO: 104967 - DNA, 707 bp, Homo sapiens
  misc_feature: GYAE6OF02GU0GZ.17.34.D01.1.454.CMB.1.raw
  modified_base (297)..(297): a, c, t, g, unknown or other
  misc_feature (297)..(297): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggagttcctcttgtggtggcagcagctacaggtgtccagtcccaggtccagttggtgcaatcgtggggctgaggtgaagacgcctgggtcctcggtgagggtctccgtgcaaggtccttcgagggacggcctacctttcgaggcgtaacttagttagtttcaagttggggtnacggaccgggtcctcgtggaacaaggtccttggacgtggacgtagggagtatccggttacctagttcgtagacgaacctaacctaaacgtcgaccaacgaggtaacgttccgaggaccaggacctcactacgtaacgacggaactaaattaacgaactacgtagttaactcgtaggactcgtagacgtacgtccaggtaactagtcccgtagaacggtacgtaccgggtacttacccgttaacgttccggttagggtgtaaaccgggaaggttaacgtttaaacgtaaccttaaagtacccgttaagtcccgtttaacccttttacccttttaacccgacccttttccggtattaccggttcggtaccggtaccgtacgttacccggacccccgttcgacccttacccgg

SEQ ID NO: 104968 - DNA, 676 bp, Homo sapiens
  misc_feature: GYAE6OF02G08TR.17.34.D01.1.454.CMB.1.raw
  modified_base (142)..(142): a, c, t, g, unknown or other
  misc_feature (142)..(142): n is a, c, g, or t
  modified_base (293)..(293): a, c, t, g, unknown or other
  misc_feature (293)..(293): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
  modified_base (537)..(537): a, c, t, g, unknown or other
  misc_feature (537)..(537): n is a, c, g, or t
  modified_base (546)..(546): a, c, t, g, unknown or other
  misc_feature (546)..(546): n is a, c, g, or t
tcagcgtagactagcacgaccggtgctcgatttagatcgtctgtgttgggttgggacaaaacaccagattcctcctctaaagaacgcccctgggagcacagctcatcaccagtggactggaccttggaggttccttctttgnggtggcagcagctacgaggtcgtaccacgtcctaaggtccaggtttcggtgaccaagtccgtggggctaggacggtagaacggaccgcccgttgggtccttgggagtcgggtactccgtagacgtaaggtcttcgaggacgtctaaccgtnagactacttatagttacgagttcgggcgacggccggtctagtcgggaacctaacggtaccttgggaggtggtaagtacggggagtaccgtttccgtaccggtatcggtacgacctaaccgtaacaacgtcgacaaggtacggtactccggagactaggtactcgaactacggtaccgacgaataaacgtacaactanacgtacacgngtacgcacgaacactctacgacgtactacgtagacgngtaaccgtntccgtacgttacgtgccgtaagtagtaattaccgtaatacgtaactcgtacttacgtttaccttaaccttacccttgtaaccgttcgtaccgttacggtctaccggtaccggtcccgtaccgtacgtccc

SEQ ID NO: 104969 - DNA, 699 bp, Homo sapiens
  misc_feature: GYAE6OF02HP05I.17.34.D01.1.454.CMB.1.raw
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (578)..(578): a, c, t, g, unknown or other
  misc_feature (578)..(578): n is a, c, g, or t
  modified_base (603)..(603): a, c, t, g, unknown or other
  misc_feature (603)..(603): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggagttcctctttgtggtggcagcagctacaggtgtccagtcccaggtccaggttcggtagactaagtcgtggggcttggaggttagaaacgtccggccgttggggtcccgttagggtcggtacgggttcctccgtgaccgtaacgggtccttttccgaggggacgttccctacctttccgaaggtaccgtacttaagtttaacgtttacgtaaagttgggttagccggtaccggtcgtcgtacggactaacggtcttgaggttaggacggtagggacgtctaccgtaccgtagtcgtacgactaccaacgtaactcgacacgtagacgtcgaaggcaacgtacacacaacgtaccgagaactaataaccgactaacgtactatcgagagtctacgaacncgacttcntaacncgtagacggaacgtcggtacttcgttaacgtcgtagtagngtaagacttaagttacgtaactacnccgttcgtacttttaccgttacctccgtttacctgttaccgttacggtaccggttctaaccggtaccccgggttacccctacgttacccgttaccg

SEQ ID NO: 104970 - DNA, 745 bp, Homo sapiens
  misc_feature: GYAE6OF02FTZ0T.17.34.D01.1.454.CMB.1.raw
  modified_base (286)..(286): a, c, t, g, unknown or other
  misc_feature (286)..(286): n is a, c, g, or t
tcagcgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaacgacgccgtgggtcctcgggtgagggtctcctgcaaggcttcgtggaggcaccttcagcgactatagtttcaagttgggngccgacgggtcctcgtggacctaaggtccttaggacggtagggacgttgggggaaaggtacgttccggttaccccgttagttaccggtttacggaaccgtaaccgtaaccccgtaaaaacgttaccgaccaacgtaaggtaaaccgtttcccgaaggggtaccacggaccttaccgaaacccaacgttaaacccggaccggaaacctaaaaacgtttaacccgaaactaaccgtaaagtttaactacgtagggaacgtacttaacggaaactacggtaccctggtacctaacgtccgtaggacggtaccgtaccgggtacctttacgtacttccgtagtcggacgtaaggtaagttaaacgttaactaattaaccgacttgtacctttaccgtttaccaccttcccgttagtaccttcggtcggtccacggttaccggtaccccgtcgtaccgttcccg

SEQ ID NO: 104971 - DNA, 734 bp, Homo sapiens
  misc_feature: GYAE6OF02FL06L.17.34.D01.1.454.CMB.1.raw
  modified_base (457)..(457): a, c, t, g, unknown or other
  misc_feature (457)..(457): n is a, c, g, or t
tcagcgtagactagcacgaccggtgctcgatttagatcgtctgtgttgggtttggggacaaaacaaccagattcctcctctaaagaagccccctgggagcacagctcatcaccatggactggacctggaggttcctctttgtggtggcagcagctacgaggtgtccagtcccaggtccagttggtgcaatctggggctgaggtgaagacgcctggggtcctggtgacgggtctccgtgcaaggtcttcgtggacggctaccgttcagcgtaacttagtaacgtttcaaagtttggggtagaccggaccgggtccctcgtaggaacgaaggtccctttggaacggtggagtagggaaggacttcggtccctagtcgttagaactacaaccaaatacgcaacagtaacgtcagggtacaggactcaacctataaccgagaactaaaacgttaaccgaanacgtaacgttaaatcgtaggtaacgactacgaaacacgacctagtaccaattccgtacgaacggaccgtaacgggtctttaccttaacgttcgtacggtagtaccggtaaggtaaactttaaactttacgtaaaccgttaaacttccgttaaggtcccttttaacccggtttttaaccaccccgttttacccgtacgtttaacccgttttcggaccgggtacccttaaggttacccccggggtaaacccccggtttccgtaacccccggtttacccg

SEQ ID NO: 104972 - DNA, 882 bp, Homo sapiens
  misc_feature: GYAE6OF02IV2LT.17.34.D01.1.454.CMB.1.raw
  modified_base (136)..(136): a, c, t, g, unknown or other
  misc_feature (136)..(136): n is a, c, g, or t
  modified_base (148)..(148): a, c, t, g, unknown or other
  misc_feature (148)..(148): n is a, c, g, or t
  modified_base (164)..(164): a, c, t, g, unknown or other
  misc_feature (164)..(164): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
tcagcgtagactagcacgaccggtgctcgatttagatcgtctgtgttggggtttgggggatcacaaaacaaccagattcctcctctaaaagaacgccccctggggagcacagctcatcaccatggactgacctggngttcctctttgnggtggcagcagctacnggtgtccagtcccaggtccagttggtgcaatcgngggctgnggtagaacgcggccgtgggtacctgggtaggacggttcctcctacggactaacggtcctttccgagggtaccggacctacccttagacggtaccacgttaactacgtttacgtaaacggttgggtacggaccggaccgggtccttacgtacggaacgtaacgggtccgttaggaggttagggacggtagggggaaacggtactaccggttacccttagttaccgttacgaaccgtaacctaaccgaaacgtacggaccaaccgtaaacggtaaccgttaccggaacggtactaacggtacaacccgtaaccgtaaacccgtaacccggtaaccgggtaaaacctaaaacggtaaaacccgtaaaccgtaaactttaaacgggtaaaaccgtttaccggttaaaggtaaaccggtactaaacgggaacccgttaaccggtaccgtttaacgggtaccttacggtaccgttaacgggaaaccggtaaaccggtccggttaaccgtttacttaccggttcgttagtacggtaacggttaagggtaactttaaaccggttaaccttaagtaacctacggttccgtttactttacccgtttaacccgtaccgtttacccctttaccgttacggttaccgttacggggaccctaaccgggttacccggtaacccgtaccccgg

SEQ ID NO: 104973 - DNA, 717 bp, Homo sapiens
  misc_feature: GYAE6OF02IHHXG.17.34.D01.1.454.CMB.1.raw
  modified_base (187)..(187): a, c, t, g, unknown or other
  misc_feature (187)..(187): n is a, c, g, or t
  modified_base (616)..(616): a, c, t, g, unknown or other
  misc_feature (616)..(616): n is a, c, g, or t
tcagcgtagactagcacgaccggtgctcgatttagatcgtctgtgttgggtttggggatcacaaaacaaccagattcctcctctaaaagaagcccctgggagcacagctcatcaccatggactggacctggaggttcctctttgtggtggcagcagctacaggtgtccagtcccaggtccagttggngcaatcgtggggctgaggtgaagacgccgtgggtcctggtgagggtctccgtgcgaaggtcttcgtggaggcctaccttcaggccgaactattagttttcgaaagttgggtagccggacgggtcccttcgtcggaaccgacggtcctttaggtaaggttacgggagttgggggaaaggtacgttcccggttaccccttaagttccggtttacgaaccgtaaccgaacccgtaaaaccgttaccggaccaacgtaacgtaaacggttcccgaaggggtccaaacggtacctaaccaaccgaacggttaaacccggacgggtaaacctaaactttaaaccgaaacctaacgtaaacgtttaactacgtaggagtacctagaaccgacgtccttaggttacagtctagaggaccgacggtcttactcttcgngtcgacgtagtacgtaattactaactactacgtatcctttacctttacaccctttccttacgtacgttcggtaccggcctacgtcccggtacccggtaccc

SEQ ID NO: 104974 - DNA, 879 bp, Homo sapiens
  misc_feature: GYAE6OF02JPY84.17.34.D01.1.454.CMB.1.raw
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggagttcctctttgtggtggcagcagtctacgaggtcgtccgagtcccagggtcctagtttggcgactaatcgtggggcttggacgtgaacgacgccgtgggtcctggtgaggtcctcgtgacgacgtcttgnggaggcctacgttcgacggtccgtaacttacgttagttcgtaagtttcggggtcnccgggtaccgggtaccttggtacggtaaccgtaacgggtcccgtttaggacgggtttaggacggtaacggggtaaggttccgttcccgttacccgttagttccggttacgaaccctaaccgtaacccgtaaaccgtaccggaccgtaaaccgtacggggttaaaccgttcccggaacgggtaccaacggtacccgtaaccgtaacccgtaaacggtaacccggaccgttaaaagtaaaccgtttaaccgaacgtaaccgttaacggtttaaccgacggtacggtaacgtacgtacggtaacctacgtaccgttagtacgtacgttacggtaagggtaccggtaccgtacgggttacttttaccggtaaccgtttcgttaaacgggtcgggtaaacccggtaggtttaaaccgttaaccgttaacggttaaccttaccgttacggttacccgttaacccgtttttaacccttttaccaccccggttttactttaccggaaccgtttttaccgggaccggttaaccccttaacccgggttaacccgggttcccccggtttaaccgg

SEQ ID NO: 104975 - DNA, 717 bp, Homo sapiens
  misc_feature: GYAE6OF02HQE8I.17.34.D01.1.454.CMB.1.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctggtggagggtcctccgtgacgaaggtcttcgtgggacgccaccgttcagccgactattacgtttacgaagttggggtcgcggtaccgggtcctcgtagggaacgaacggccgtttaggaggtacgggaggtaggggaaacggtacgttaccggttcccgttaagttcggtttacgaacctaaccaaaccctaaaaccgtaccgacaaaccgaaggtaaaccggttaccggaacgggactaacgtacctaccaccgaaaccgtaacccggacggtaaactaaaacgttaaacgaacctaaacgtaagttaactacgtaggactacgacgaagacgtaccttgtacatcgtagacggacgtacggtccttacgtacgttcgtgtacgagtaacgtagtaacttactaatacgtacgtcgttactttaccctttacctcccttaccgtttacgtaccgttcggtacggtacctacggtacccggtacccgtacccg

SEQ ID NO: 104976 - DNA, 824 bp, Homo sapiens
  misc_feature: GYAE6OF02FGLZ0.17.34.D01.1.454.CMB.1.raw
  modified_base (211)..(211): a, c, t, g, unknown or other
  misc_feature (211)..(211): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgtaggtgtccagtcccaggtccagttggtcgcaagtcgtggggctggaggtnaagaccgcctgggtcctccggtgacgggttcctccgttgacctaagggtccttacgtgggacgtccgtaccgtttcaacggtcgaaccttagtttacggttttacgaaagttttcggggtacggtaccggtaaccggggtcccttacgttacgggaacctaaacgggggtcccctttagggaccggttagggtaacgtacggggaaacgttcgttacccgttaccccgtaagtttccggttacgaacccgtactaacccgtaaacgtcccgacaacggtaacgtacgttcccgaagggtcaacggtaccgttaccaacccgtaacgtaacccggacggtaaacctaaacgtaaccgaaactaacgtaaccgttaaacgtacgtaggaacgtccgtaacgtaacgtaccgtcgttacgtacgttacgttacgtacgacgggtaaccggtacggttaccgttacgttaccgttacgttcggtaggtaccggtaagtaacgttacttacgttaactaccgtaactcggttaaccttaccgttttaacccgaccctttaccgttacgttaccgttacggtaccggtaccgtaaccggttacccgtacccgttacccg

SEQ ID NO: 104977 - DNA, 824 bp, Homo sapiens
  misc_feature: GYAE6OF02I017U.17.34.D01.1.454.CMB.1.raw
  modified_base (96)..(96): a, c, t, g, unknown or other
  misc_feature (96)..(96): n is a, c, g, or t
  modified_base (159)..(159): a, c, t, g, unknown or other
  misc_feature (159)..(159): n is a, c, g, or t
  modified_base (183)..(183): a, c, t, g, unknown or other
  misc_feature (183)..(183): n is a, c, g, or t
tcagcgtagactagcacgaccggtgctcgatttagatcgtctgtgttgggtttggggacaaacaaccagattcctctctaaagaagcccctgggancacagctcatcaccatggactggacctggaggttcctctttgtggtggcagcagctacaggtntccagtcccaggtcagttggtcgnaagtcgtggggctggaggtagaagacgtccgtgggtcctcggtaggacggttcctctacgcgaaggtccttcgagggacgcctaccgttcgagtccgaacttagttacgtttacgaagttcggggtacgaccggtacccgggtctacggtaggaaccgtaaggttccgtggacggttggaacggttaggggaacggtacttaccggtacctagttcgtacgaacctaccgaaacctaacgtaccgacgtaacgtaacgtaaccggtccgaacgggtcgtaaacggttctaaccgtaaacccgtaagtaacccgggtaccgtaaaaacggttaaacgttaaacccgaaacgtaaccgtaaaagtttaacccgttagaacggtaacggtacgttaaacgacgtaaccgtcgtacggttactaaacgttccggaaggttaaccgaacccgttaccgggtacctttaccgttaccgttaggtacggtacggaacggttaacggtaactttaaaggtttaaacccttaagtaaccgtcgtaccgttttaccgtttacctttttaacccggaccctttcgttaccgttacgttcccgggttaggtacccgtaccgtttaccgggaccccctttggtaaccccgttcg

SEQ ID NO: 104978 - DNA, 858 bp, Homo sapiens
  misc_feature: GYAE6OF02I00O6.17.34.D01.1.454.CMB.1.raw
  modified_base (330)..(330): a, c, t, g, unknown or other
  misc_feature (330)..(330): n is a, c, g, or t
tcagcgtagactagcacgaccggtgctcgatttagatcgtctgtgttgggttggggatcacaaaacaaccagattcctcctctaaagaagcccctgggagcacagctcatcaccatggactggacctgggacgttcctctttggtggtggcagcagctacgaggtcgtccaacgtcccgaggtccgtagttgggtgacaacgttcggtggggtctaggtagggtagaacgtacggtccgtgggttacccgtgggtaggtacgggtctccgtggactagggtcttcggacggtacggactaaccgtcgaacgtcgtaacttagttacgttntaaacggttgggtacgtcggaccgtctcggtacggaccgtaaggtccgtgtaggtggtacggtaacggggaagtaccgttccgtaccgtaacgttccggtaacgtaccgtaaccgtaaaacccgtaaaaccgtcgaccgtaaacgtaaacggtaccgttaaccggacggaaccgtaaacgttacccgaaccgtaaacccgtaaaccgttaaaccggaacccggtaaaacgtaaaacccggtttaaaacccgaaaacgtaaacccttaaaggtttaactaaccgggttacccgaaagtacccgttaaaggaaccgtacggtaccgttacgttaactaacgtcgttaccggaacgtacccggacgtttccttaccgtaccggttacgtcggtacggaccgttaaggtaaacttaaacgttacaaaccgttacgtacctttaccgttttacccttaaccgtccgttaacccgtctttaccggttacgtaccggtacggttaacccggtaaccggttccccttaacgtcccg

SEQ ID NO: 104979 - DNA, 132 bp, Homo sapiens
  misc_feature: GYAE6OF01CCAP1.51.14.B03.1.454.CMB.1.raw
  modified_base (126)..(132): a, c, t, g, unknown or other
  misc_feature (126)..(132): n is a, c, g, or t
tcagcgatcgtatacacgaccggtgctcgatttagtgtgagtagttccgcggctggcaaggcgcatagccttagggattcagtgataggtacgcactcgtctgagcgggctggcaaggcgcatagnnnnnnn

SEQ ID NO: 104980 - DNA, 226 bp, Homo sapiens
  misc_feature: GYAE6OF01BMH9W.51.14.B03.1.454.CMB.1.raw
  modified_base (197)..(198): a, c, t, g, unknown or other
  misc_feature (197)..(198): n is a, c, g, or t
  modified_base (200)..(226): a, c, t, g, unknown or other
  misc_feature (200)..(226): n is a, c, g, or t
tcagcgatcgtatacacgaccggtgctcgatttagtgtgagtagttccgcgggcacggaccggttgctcgatttacgtgtgagtagttccgcgggtccacgaccggtgctcgactttagagtgctacgaagggaaggcagcgtcactctgttcccgcctctctcgtagcactctgagcggctggcaaggcgcatagnntnnnnnnnnnnnnnnnnnnnnnnnnnnn

SEQ ID NO: 104981 - DNA, 156 bp, Homo sapiens
  misc_feature: GYAE6OF01BCDA1.51.14.B03.1.454.CMB.1.raw
  modified_base (156)..(156): a, c, t, g, unknown or other
  misc_feature (156)..(156): n is a, c, g, or t
tcagcgatcgtatacacgaccggtgctcgatttagtgtgagtagttccgcgggcacgaccggtgctcgatttagagtgctacgaagggaagggcagcgtcactctgttcccaccctcctctcgtagcactctgagcgggctggcaaggcgcatagn

SEQ ID NO: 104982 - DNA, 242 bp, Homo sapiens
  misc_feature: GYAE6OF01CLVC8.51.14.B03.1.454.CMB.1.raw
  modified_base (232)..(232): a, c, t, g, unknown or other
  misc_feature (232)..(232): n is a, c, g, or t
  modified_base (238)..(242): a, c, t, g, unknown or other
  misc_feature (238)..(242): n is a, c, g, or t
tcagcgatcgtatacacgaccggtgctcgatttagtgtgagtagttccgcgggcacgaccggtgctcgatttagtgtgagtagttccgcgggcacgaccggtgctcgatttagagtgctacgaagggaaagggcacgaccggtgctcgatttagagtgctaacggaagggaaaggcagcgtcactctgttcccgccctcctctcgtagcactctgagcgggctggcaaggcncatagnnnnn

SEQ ID NO: 104983 - DNA, 157 bp, Homo sapiens
  misc_feature: GYAE6OF01BFSJP.51.14.B03.1.454.CMB.1.raw
  modified_base (157)..(157): a, c, t, g, unknown or other
  misc_feature (157)..(157): n is a, c, g, or t
tcagcgatcgtatacacgaccggtgctcgatttagtgtgagtagttccgcgggcactaccggtgctcgatttagagtgctacgaagggaaagggcagcgtcactctgttcccaccctcctctcgtagcactctgagcgggctggcaaggcgcatagn

SEQ ID NO: 104984 - DNA, 199 bp, Homo sapiens
  misc_feature: GYAE6OF01E1XE7.51.14.B03.1.454.CMB.1.raw
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (194)..(199): a, c, t, g, unknown or other
  misc_feature (194)..(199): n is a, c, g, or t
tcagcgatcgtatacacgaccggtgctcgatttagtgtgagtagttccgcgggcacgaccggtgctcgatttagtgtgagtagttccgcgggcacgaccggtgctcgatttagctgtgcgtcgaagggaaggcagcgtcactctgttcccaccctctctcgtagcactctgagcgggntggcaaggcncatagnnnnnn

SEQ ID NO: 104985 - DNA, 197 bp, Homo sapiens
  misc_feature: GYAE6OF01B36OS.51.14.B03.1.454.CMB.1.raw
  modified_base (161)..(197): a, c, t, g, unknown or other
  misc_feature (161)..(197): n is a, c, g, or t
tcagcgatcgtatacacgaccggtgctcgatttagtgtgagtagttccgcggggcacgaccggtgctcgatttagagtgctacgaagggaaagggcagcgtcactctgttcccgccctcctcgtcgtagcactctgagcggggctgggcaaggcgcatagnnnnnnnnnnnnnnnnnnnnnnnnnnnnnnnnnnnnn

SEQ ID NO: 104986 - DNA, 203 bp, Homo sapiens
  misc_feature: GYAE6OF01CUMXC.51.14.B03.1.454.CMB.1.raw
  modified_base (192)..(203): a, c, t, g, unknown or other
  misc_feature (192)..(203): n is a, c, g, or t
tcagcgatcgtatacacgaccggtgctcgatttagtgtgagtagttccgcgggcacgacctgtgctcgatttagtgtgagtagttcgcgggcacgaccggtgctcgatttagagtgctaacggaagggaaggcagcgtcactctgtcccgccctcgtctcgtagcactctgagcggctggcaaggcgcatgnnnnnnnnnnnn

SEQ ID NO: 104987 - DNA, 197 bp, Homo sapiens
  misc_feature: GYAE6OF02H9NHZ.51.14.B03.1.454.CMB.1.raw
  modified_base (197)..(197): a, c, t, g, unknown or other
  misc_feature (197)..(197): n is a, c, g, or t
tcagcgatcgtatacacgaccggtgctcgatttagtgtgagtagttccgcgggcacgaccggtgctcgatttagtgtgagtagttccgcgggcacgaccggtgctcgatttagctgtgcgtcgaagggaaagggcagcgtcactctgttcccaccctcctctcgtagcactctgagcgggctggcaaggcgcatagn

SEQ ID NO: 104988 - DNA, 161 bp, Homo sapiens
  misc_feature: GYAE6OF02FGQEQ.51.14.B03.1.454.CMB.1.raw
  modified_base (128)..(132): a, c, t, g, unknown or other
  misc_feature (128)..(132): n is a, c, g, or t
  modified_base (135)..(161): a, c, t, g, unknown or other
  misc_feature (135)..(161): n is a, c, g, or t
tcagcgatcgtatacacgaccggtgctcgatttagtgtgagtagttccgcgggctggcaaggcgcatagctgcctggtcaaggactacttcctcgtagcactctgagcgggctggcaaggcgcatagnnnnnagnnnnnnnnnnnnnnnnnnnnnnnnnnn

SEQ ID NO: 104989 - DNA, 169 bp, Homo sapiens
  misc_feature: GYAE6OF02GF1GR.51.14.B03.1.454.CMB.1.raw
  modified_base (157)..(169): a, c, t, g, unknown or other
  misc_feature (157)..(169): n is a, c, g, or t
tcagcgatcgtatacacgaccggtgctcgatttagtgtgagtagttccgcgggcacgaccggtgctcgatttagagtgctacgaagggaaagggcagcgtcactctgttcccgccctcctctcgtagcactctgagcgggctggcaaggcgcatagnnnnnnnnnnnnn

SEQ ID NO: 104990 - DNA, 182 bp, Homo sapiens
  misc_feature: GYAE6OF02IOMKU.51.14.B03.1.454.CMB.1.raw
  modified_base (158)..(182): a, c, t, g, unknown or other
  misc_feature (158)..(182): n is a, c, g, or t
tcagcgatcgtatacacgaccggtgctcgatttagtgtgagtagttccgcggggcacgaccggtgctcgatttagagtgctacgaagggaaagggcagcgtcactctgttcccaccctcctctcgtagcactctgagcgggctggcaaggcgcatagnnnnnnnnnnnnnnnnnnnnnnnnn

SEQ ID NO: 104991 - DNA, 159 bp, Homo sapiens
  misc_feature: GYAE6OF02H7GLR.51.14.B03.1.454.CMB.1.raw
  modified_base (157)..(159): a, c, t, g, unknown or other
  misc_feature (157)..(159): n is a, c, g, or t
tcagcgatcgtatacacgaccggtgctcgatttagtgtgagtagttccgcgggcacgaccggtgctcgatttagagtgctacgaagggaaagggcagcgtcactctgttcccgccctcctctcgtagcactctgagcgggctggcaaggcgcatagnnn

SEQ ID NO: 104992 - DNA, 157 bp, Homo sapiens
  misc_feature: GYAE6OF02FSTTJ.51.14.B03.1.454.CMB.1.raw
  modified_base (157)..(157): a, c, t, g, unknown or other
  misc_feature (157)..(157): n is a, c, g, or t
tcagcgatcgtatacacgaccggtgctcgatttagtgtgagtagttccgcgggcacgaccggtgctcgatttagagtgctacgaagggaaagggcagcgtcactctgttcccaccctcctctcgtagcactctgagcgggctggcaaggcgcatagn

SEQ ID NO: 104993 - DNA, 176 bp, Homo sapiens
  misc_feature: GYAE6OF02GXRNW.51.14.B03.1.454.CMB.1.raw
  modified_base (156)..(176): a, c, t, g, unknown or other
  misc_feature (156)..(176): n is a, c, g, or t
tcagcgatcgtatacacgaccggtgctcgatttagtgtgagtagttccgcgggcacgaccggtgctcgatttagagtgctacgaagggaagggcagcgtcactctgttcccaccctcctctcgtagcactctgagcgggctggcaaggcgcatagnnnnnnnnnnnnnnnnnnnnn

SEQ ID NO: 104994 - DNA, 140 bp, Homo sapiens
  misc_feature: GYAE6OF02HQKNJ.51.14.B03.1.454.CMB.1.raw
  modified_base (128)..(140): a, c, t, g, unknown or other
  misc_feature (128)..(140): n is a, c, g, or t
tcagcgatcgtatacacgaccggtgctcgatttagtgtgagtagttccgcgggctggcaaggcgcatagctgcctggtcaaggactacttcctcgtagcactctgagcgggctggcaaggcgcatagnnnnnnnnnnnnn

SEQ ID NO: 104995 - DNA, 139 bp, Homo sapiens
  misc_feature: GYAE6OF02HWKFF.51.14.B03.1.454.CMB.1.raw
  modified_base (128)..(139): a, c, t, g, unknown or other
  misc_feature (128)..(139): n is a, c, g, or t
tcagcgatcgtatacacgaccggtgctcgatttagtgtgagtagttccgcgggctggcaaggcgcatagctgcctggtcaaggactacttcctcgtagcactctgagcgggctggcaaggcgcatagnnnnnnnnnnnn

SEQ ID NO: 104996 - DNA, 228 bp, Homo sapiens
  misc_feature: GYAE6OF02HMZU8.51.14.B03.1.454.CMB.1.raw
  modified_base (196)..(228): a, c, t, g, unknown or other
  misc_feature (196)..(228): n is a, c, g, or t
tcagcgatcgtatacacgaccggtgctcgatttagtgtgagtagttccgcgggcacggaccggtgctcgatttagtgtgagtagttccgcgggtccacgaccggtgctcgatttagagtgctacgaagggaaaggcagcgtcactctgttcccgcctcctctcgtagcactctgagcggctggcaaggcgcatagnnnnnnnnnnnnnnnnnnnnnnnnnnnnnnnnn

SEQ ID NO: 104997 - DNA, 157 bp, Homo sapiens; identical to SEQ ID NO: 104992
  misc_feature: GYAE6OF02F06G5.51.14.B03.1.454.CMB.1.raw
  modified_base (157)..(157): a, c, t, g, unknown or other
  misc_feature (157)..(157): n is a, c, g, or t

SEQ ID NO: 104998 - DNA, 364 bp, Homo sapiens
  misc_feature: GYAE6OF02G3P0Y.51.14.B03.1.454.CMB.1.raw
  modified_base (255)..(255): a, c, t, g, unknown or other
  misc_feature (255)..(255): n is a, c, g, or t
  modified_base (316)..(364): a, c, t, g, unknown or other
  misc_feature (316)..(364): n is a, c, g, or t
tcagcgatcgtatacacgaccggtgctcgatttagtgtgagtagttccgcgggcacgaccggtgctcgatttagtgtgagtagttccggacgggcacgaccggtgctcgatttacgacgacagctacgaggggtgctcgatttaggtgtgacgtagttccgcgggcacggaccggtgctcgatttagtgtgagtaagtccgcgggcacgaccggtgctcgatttagagtgctaacgaagggaaagggcagtcgtnaactctgttcccgcctcctctcgtaagcactctgagcgggctggacaaaggcgcaataggnnnnnnnnnnnnnnnnnnnnnnnnnnnnnnnnnnnnnnnnnnnnnnnnn

SEQ ID NO: 104999 - DNA, 635 bp, Homo sapiens
  misc_feature: GYAE6OF01D5ZJ2.25.14.B03.1.454.CMB.1.raw
  modified_base (247)..(247): a, c, t, g, unknown or other
  misc_feature (247)..(247): n is a, c, g, or t
tcagactgtacagtcacgaccggtgctcgatttagtgtgagtagttccgcgggggaggcctggaggttcctccctagctgtgggctcagaagcagagttcaggggtgtctccaccatggcctggacccctctctggctcactctcctcactctttgcataggttctgtggtttcttctgagctgactcaggaccctgctgtgtctgtggccttgggacagacagtcaggatcacatcgaccaagganacagcctcacgaccctattatgcaagctaggtaccagcaagaacgccaaggaccacggcccctgtagttgtcatctataggtaaaatcgcccggcctcgacgggactcccgagaccgtattctcgtcggcctccgagctacgaacggaaacactacgtccttcctacgacctactccgacggtcgggcctacgacgggcggaggagtaggacggtctacggacgtttactttcgtagggttaacggttccgggaaactaacgtacggttagtaacttcggtacccttaccgtttagttaacgttcgtttacgggtaaaccgttacggggaaaccctaacggtacccgtaacccggtacccgttacggtaccgaccggtaaacccccgg

SEQ ID NO: 105000 - DNA, 721 bp, Homo sapiens
  misc_feature: GYAE6OF01A18NI.25.14.B03.1.454.CMB.1.raw
tcagactgtacagtcacgaccggtgctcgatttagtgtgagtagtttgggtttgagggccttctgagagtcatggacctcctgtgcaagaacatgaagcacctgtggttcttcctcctgctggtggcggcgcccagatgggtcctgtcccagctgcgtctgcaggagtcgagcccgagggcagggtgaagccttcggacgaccctgtccctcacctgctctgtctctggtcacctccatccaccagtaactgctactagttacggtggggctcggcctccgccaccggccccgaggggaacggccgtgggagtggtagttgacgtattgtctttacagtaggtgggtacgtcgaccttaaccgtacaccgttccccctccgtacgaacgcgtaccgtacgtacctaccgttacgtttaccggttacgaaccgtaccttaccgacgacgaacgtacgttacgttcgtcttacgtacggaacctacgtacgtcttcgttcggtacccggaccggtccccgacggacccggtaccggtacccgttactttaacgttaccgtcggtacggacggtaacgtaggtacccggcggtaacccgggtaacccgtaaaaccccctacccgttaaaccccgtttacgtttacccgacccggtacccgggtacgggaacccggttacgggtaaaccccggtggtaacccctcccggtcctaccccggtaccg

SEQ ID NO: 105001 - DNA, 774 bp, Homo sapiens
  misc_feature: GYAE6OF01CE95I.25.14.B03.1.454.CMB.1.raw
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (622)..(622): a, c, t, g, unknown or other
  misc_feature (622)..(622): n is a, c, g, or t
  modified_base (755)..(755): a, c, t, g, unknown or other
  misc_feature (755)..(755): n is a, c, g, or t
tcagactgtacagtcacgaccggtgctcgatttagtgtgagtagttccggcgggggaggcctggaggttccctccctagctggtgggctcagaagcagagttcgaggggtgtctccaccagtggcctcgggaccccctctctgggctcactcctcctcacttctttgactagttaggttcttggttggttttcttcgtgacgtctcgtacctcgaacggccctggtcttgtgtcgtggtcgggtccgtagggacacgtanagtcgagtntcanancggaaccgaaggacgactcgcctacgacgtaccttatatagaccagcgttacggaacacgacgaaggaacgccgtaaccggaaccgtaccggtacccgtttaggttagtacgtacgttaatacgttaaacggttaacggtaaaaccggtcccgtacccggtacccgtacggtaacggtaccgaacccgaccgggtaaacttcgttaccggttacgttccgggacctacccggtaacgtcctaacggaaaacgtaaccccgacgtttaccctaccggtttccgtaacctaccgtaacgttaccggacgggtgggttaaccccgaggggtccggtaacgggagtacggnggtacgtacggtttacttctttacgttacgacggttaacgggtacgaactaaggcgtagtaccgtccttacgttcttaacgtcgtttacggacgtaacggtaaccggaagtacgtccccgtagtaaccccggntccgtaacctaaccccggg

SEQ ID NO: 105002 - DNA, 192 bp, Homo sapiens
  misc_feature: GYAE6OF02GFD4K.25.14.B03.1.454.CMB.1.raw
  modified_base (190)..(192): a, c, t, g, unknown or other
  misc_feature (190)..(192): n is a, c, g, or t
tcagactgtacagtcacgaccggtgctcgatttagtgtgagtagttccgggacaacagtgatgacctcctttatatcttcggaactgggaccaaggtcaccgtcctaggtcagcccaaggccaaccccactgtcactctgttcccaccctcctcactgtacagtctgagcgggctggcaaggcgcatagnnn

SEQ ID NO: 105003 - DNA, 239 bp, Homo sapiens
  misc_feature: GYAE6OF02F8HF0.25.14.B03.1.454.CMB.1.raw
  modified_base (219)..(239): a, c, t, g, unknown or other
  misc_feature (219)..(239): n is a, c, g, or t
tcagactgtacagtcacgaccggtgctcgatttagtgtgagtagtttgggtttagggtgcccaagctgctggagggccacggtcgacccacgctacgctgagggagtagagtcctgaggactgtaggacagccgggaaggtgggcacagcggccctgggctgcctggtcaaggactacttccactgtacagtctgagcgggctggccaaggcgcatagnnnnnnnnnnnnnnnnnnnnn

SEQ ID NO: 105004 - DNA, 191 bp, Homo sapiens
  misc_feature: GYAE6OF02H54MN.25.14.B03.1.454.CMB.1.raw
  modified_base (190)..(191): a, c, t, g, unknown or other
  misc_feature (190)..(191): n is a, c, g, or t
tcagactgtacagtcacgaccggtgctcgatttagtgtgagtagttccgggacaacagtgatgacctcctttatatcttcggaactgggaccaaggtcaccgtcctaggtcagcccaaggccaaccccactgtcactctgttcccgccctcctcactgtacagtctgagcgggctggcaaggcgcatagnn

SEQ ID NO: 105005 - DNA, 720 bp, Homo sapiens
  misc_feature: GYAE6OF02H7XVR.25.14.B03.1.454.CMB.1.raw
  modified_base (552)..(552): a, c, t, g, unknown or other
  misc_feature (552)..(552): n is a, c, g, or t
  modified_base (575)..(575): a, c, t, g, unknown or other
  misc_feature (575)..(575): n is a, c, g, or t
tcagactgtacagtcacgaccggtgctcgatttagtgtgagtagttccgcgggggaggcctggaggttcctccctagctgtgggctcagaagcagagttcaggggtgtctccaccatggcctggacccctctcctcctccagcttctccaccctctgctcagggtcctgggcacagtctgcgctcgacccgaggaagactcggtgtcgggacgtggacagaagtcacctgttcttgttctggtacgagcgacaacagttggtaactatccgtggtcggtcgtcggtaacctaaacgaggtaacgtcggtaccccgtaaccccggtaacccccccctaaaaagttcggtacgtaacgttcggtttccggtacggacgtacgtttccgttacccccgtcccgttacggacggggttaccctccggtccgacccgtccttcgtcgtcgggtctagtcgtgcggacacgacgtcctcagtactcgtccggcggtccctccgacgtaccgttggacggacggtcgtaccggttccgttaaccgtcgtaccgctacgngtccgtagtacggtacttaccgngtacggtcctcggttcgtcgtccgttacggtccgggtttccggtaccggggggtccggggttacccgttccgggtacccgttcggttaccggcgtaccgacccgtacgccgtcccgtcccggtaccgtcttacccgtcgttcccg

SEQ ID NO: 105006 - DNA, 176 bp, Homo sapiens
  misc_feature: GYAE6OF01EQND1.2.22.B11.1.454.CMB.1.raw
  modified_base (169)..(176): a, c, t, g, unknown or other
  misc_feature (169)..(176): n is a, c, g, or t
tcagacgctcgacacacgaccggtgctcgatttagacgacagctcagggcccatcggtcttcccctggcaccctcctccaagagcacctctggggcacagcggccctgggctgcctggtcaaggactacttcctgtcgagcgtctgagcgggctggcaaggcgcatagnnnnnnnn

SEQ ID NO: 105007 - DNA, 173 bp, Homo sapiens
  misc_feature: GYAE6OF01CCDNW.2.22.B11.1.454.CMB.1.raw
  modified_base (171)..(173): a, c, t, g, unknown or other
  misc_feature (171)..(173): n is a, c, g, or t
tcagacgctcgacacacgaccggtgctcgatttagacgacagctcagggcccatcggtcttccccctggcaccctcctccaagagcacctctgggggcacagcggccctgggctgcctggtcaaggactacttcctgtcgagcgtctgagcgggctggcaaggcgcatagnnn

SEQ ID NO: 105008 - DNA, 177 bp, Homo sapiens
  misc_feature: GYAE6OF01ANUW0.2.22.B11.1.454.CMB.1.raw
  modified_base (171)..(177): a, c, t, g, unknown or other
  misc_feature (171)..(177): n is a, c, g, or t
tcagacgctcgacacacgaccggtgctcgatttagacgacagctcagggcccatcggtcttccccctggcaccctcctccaagagcacctctgggggcacagcggccctgggctgcctggtcaaggactacttcctgtcgagcgtctgagcgggctggcaaggcgcatagnnnnnnn

SEQ ID NO: 105009 - DNA, 171 bp, Homo sapiens
  misc_feature: GYAE6OF01BTTUJ.2.22.B11.1.454.CMB.1.raw
  modified_base (169)..(171): a, c, t, g, unknown or other
  misc_feature (169)..(171): n is a, c, g, or t
tcagacgctcgacacacgaccggtgctcgatttagacgacagctcagggcccatcggtcttcccctggcaccctcctccaagagcacctctggggcacagcggccctgggctgcctggtcaaggactacttcctgtcgagcgtctgagcgggctggcaaggcgcatagnnn

SEQ ID NO: 105010 - DNA, 170 bp, Homo sapiens
  misc_feature: GYAE6OF01AWQIB.2.22.B11.1.454.CMB.1.raw
  modified_base (169)..(170): a, c, t, g, unknown or other
  misc_feature (169)..(170): n is a, c, g, or t
tcagacgctcgacacacgaccggtgctcgatttagacgacagctcagggcccatcggtcttcccctggcaccctcctccaagagcacctctggggcacagcggccctgggctgcctggtcaaggactacttcctgtcgagcgtctgagcgggctggcaaggcgcatagnn

SEQ ID NO: 105011 - DNA, 209 bp, Homo sapiens
  misc_feature: GYAE6OF01DOL75.2.22.B11.1.454.CMB.1.raw
  modified_base (173)..(174): a, c, t, g, unknown or other
  misc_feature (173)..(174): n is a, c, g, or t
  modified_base (176)..(209): a, c, t, g, unknown or other
  misc_feature (176)..(209): n is a, c, g, or t
tcagacgctcgacacacgaccggtgctcgatttagacgacagctcgagggcccatcggtcttcccctggcaccctcctccaagagcacctctgggggcaccagcggccctgggctggcctggtcaaggactacttcctgtcgagcgtctgagcgggctggcaaggcgcatagnncnnnnnnnnnnnnnnnnnnnnnnnnnnnnnnnnnn

SEQ ID NO: 105012 - DNA, 186 bp, Homo sapiens
  misc_feature: GYAE6OF01A5XRB.2.22.B11.1.454.CMB.1.raw
  modified_base (172)..(186): a, c, t, g, unknown or other
  misc_feature (172)..(186): n is a, c, g, or t
tcagacgctcgacacacgaccggtgctcgatttagacgacagctcagggcccatcggtcttccccctggcaccctcctccaagagcacctctgggggcacagcggccctggggctgccctggtcaaggactacttcctgtcgagcgtctgagcgggctggcaggcgcatagnnnnnnnnnnnnnnn

SEQ ID NO: 105013 - DNA, 175 bp, Homo sapiens
  misc_feature: GYAE6OF02JEXKF.2.22.B11.1.454.CMB.1.raw
  modified_base (168)..(175): a, c, t, g, unknown or other
  misc_feature (168)..(175): n is a, c, g, or t
tcagacgctcgacacacgaccggtgctcgatttagacgacagctcagggcccatcggtcttccctggcaccctcctccaagagcacctctggggcacagcggccctgggctgcctggtcaaggactacttcctgtcgagcgtctgagcgggctggcaaggcgcatagnnnnnnnn

SEQ ID NO: 105014 - DNA, 168 bp, Homo sapiens
  misc_feature: GYAE6OF02G3JAA.2.22.B11.1.454.CMB.1.raw
  modified_base (167)..(168): a, c, t, g, unknown or other
  misc_feature (167)..(168): n is a, c, g, or t
tcagacgctcgacacacgaccggtgctcgatttagacgacagctcaggcccatcggtcttccctggaaccctcctccaagagcacctctggggcacagcggccctgggctgcctggtcaaggactacttcctgtcgagcgtctgagcgggctggcaaggcgcatagnn

SEQ ID NO: 105015 - DNA, 170 bp, Homo sapiens; identical to SEQ ID NO: 105010
  misc_feature: GYAE6OF02IE9RB.2.22.B11.1.454.CMB.1.raw
  modified_base (169)..(170): a, c, t, g, unknown or other
  misc_feature (169)..(170): n is a, c, g, or t

SEQ ID NO: 105016 - DNA, 171 bp, Homo sapiens; identical to SEQ ID NO: 105009
  misc_feature: GYAE6OF02IPEGZ.2.22.B11.1.454.CMB.1.raw
  modified_base (169)..(171): a, c, t, g, unknown or other
  misc_feature (169)..(171): n is a, c, g, or t

SEQ ID NO: 105017 - DNA, 171 bp, Homo sapiens; identical to SEQ ID NO: 105009
  misc_feature: GYAE6OF02JCDRY.2.22.B11.1.454.CMB.1.raw
  modified_base (169)..(171): a, c, t, g, unknown or other
  misc_feature (169)..(171): n is a, c, g, or t

SEQ ID NO: 105018 - DNA, 169 bp, Homo sapiens
  misc_feature: GYAE6OF02HID4X.2.22.B11.1.454.CMB.1.raw
  modified_base (168)..(169): a, c, t, g, unknown or other
  misc_feature (168)..(169): n is a, c, g, or t
tcagacgctcgacacacgaccggtgctcgatttagacgacagctcagggcccatcggtcttcccctggcaccctcctccaagagcacctctggggcacagcggccctgggctgcctggtcaaggactacttcctgtcgaggtctgagcgggctggcaaggcgcatagnn

SEQ ID NO: 105019 - DNA, 176 bp, Homo sapiens
  misc_feature: GYAE6OF02JUPBN.2.22.B11.1.454.CMB.1.raw
  modified_base (169)..(176): a, c, t, g, unknown or other
  misc_feature (169)..(176): n is a, c, g, or t
tcagacgctcgacacacgaccggtgctcgatttagacgacagctcagggcccatcggtcttcccctggcaccctcctccaagacgcacctctggggcacagcggccctgggctgcctggtcaaggctacttcctgtcgagcgtctgagcgggctggcaaggcgcatagnnnnnnnn

SEQ ID NO: 105020 - DNA, 170 bp, Homo sapiens
  misc_feature: GYAE6OF02GIJRS.2.22.B11.1.454.CMB.1.raw
  modified_base (170)..(170): a, c, t, g, unknown or other
  misc_feature (170)..(170): n is a, c, g, or t
tcagacgctcgacacacgaccggtgctcgatttagacgacagctcagggcccatcggtcttcccctggcaccctcctccaagagcacctctgggggcacagcggccctgggctgcctggtcaaggactacttcctgtcgagcgtctgagcgggctggcaaggcgcatagn

SEQ ID NO: 105021 - DNA, 180 bp, Homo sapiens
  misc_feature: GYAE6OF02HX0KR.2.22.B11.1.454.CMB.1.raw
  modified_base (171)..(180): a, c, t, g, unknown or other
  misc_feature (171)..(180): n is a, c, g, or t
tcagacgctcgacacacgaccggtgctcgatttagacgacagctcagggcccatcggtcttccccctggcaccctcctccaagagcacctctgggggcacagcggccctgggctgcctggtcaaggactacttcctgtcgagcgtctgagcgggctggcaaggcgcatagnnnnnnnnnn

SEQ ID NO: 105022 - DNA, 551 bp, Homo sapiens
  misc_feature: GYAE6OF01BPSOP.10.29.C07.1.454.CMB.1.raw
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggcctcagggtttctaatcgcttctctggctccaagtctggcaacacggcctccctgaccatctctgggctccagctgagacgaggctgattattactgcagctcattattcacggccccaacgcgggttgtttcgggcggtacggggacttaaagggtgacccgtccgtggggtcacggccccaaggccctacgcccccgtcggtccaccgtcttccgttccccgcccttccccg

SEQ ID NO: 105023 - DNA, 509 bp, Homo sapiens
  misc_feature: GYAE6OF01CO990.10.29.C07.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (418)..(418): a, c, t, g, unknown or other
  misc_feature (418)..(418): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacaacacccaggcaaagccccaaactcatgatttttgatgtcagtaatcggcctcagggtttctaatcgctctctgctcaagtctgcaacacggcctcctgaccatctctcgggctccgaggctgaggacgaggctgattatactgcagctnatatacaacagacagcacttctgtattcggcgagggaccagcgtcgaccgtccgtaggtcagcccaaggcctcgcccccgtggtcctaccg

SEQ ID NO: 105024 - DNA, 575 bp, Homo sapiens
  misc_feature: GYAE6OF01BB1WJ.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacaccaggccacggccccagactcatctatttctgatgtcagtgtagtcggtccctttggtactttctaatcgtcttctctcgtcctcctaacgtctacggcaaaccgacggtccttccctgtacccacttccgtcccgggtcctccgacgctcggacggacgacggtctactatttaacttactcgcagtctacattacaccgacccgaggggcctacgtctagtcacgtagttcgggcggacgggcctcggtctacggtcccgtccgtacgtctacggacccgaaggccgtccgtcccccgtacg

SEQ ID NO: 105025 - DNA, 513 bp, Homo sapiens
  misc_feature: GYAE6OF01BSXPL.10.29.C07.1.454.CMB.1.raw
  modified_base (432)..(432): a, c, t, g, unknown or other
  misc_feature (432)..(432): n is a, c, g, or t
  modified_base (496)..(496): a, c, t, g, unknown or other
  misc_feature (496)..(496): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagccccaaactcatgattttgatgtcagtaatcggccctcagggtttctaatcgcttctctgctcagtctgcaacacgcctcctgaccatctctgggctccgaggctgaggacgaggctagattattactgcagctacatatacaaccgancagctacttctgtactcggcggtacggaccaaagcgtgacccgtcgtaggtcagcccaaggccncgccccctggtcctacg

SEQ ID NO: 105026 - DNA, 525 bp, Homo sapiens
  misc_feature: GYAE6OF01C9F1R.10.29.C07.1.454.CMB.1.raw
  modified_base (310)..(310): a, c, t, g, unknown or other
  misc_feature (310)..(310): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggccaggcccccagactcatcattctgatgtnagtgatcggccctttgggatttctaatcgtcttctctgcctcaagtctggcacacggcttccctgaccatctccgggctccactctgaggacgaggctcattattactgcagctcatatacgacccaggggtcactctcgtgtatagttcggcggagggaccgtggctcggacccgtccgtaccgtcgacgacccaaggcctccgcccctaccgg

SEQ ID NO: 105027 - DNA, 526 bp, Homo sapiens
  misc_feature: GYAE6OF01EN6CQ.10.29.C07.1.454.CMB.1.raw
  modified_base (226)..(226): a, c, t, g, unknown or other
  misc_feature (226)..(226): n is a, c, g, or t
  modified_base (425)..(425): a, c, t, g, unknown or other
  misc_feature (425)..(425): n is a, c, g, or t
  modified_base (517)..(517): a, c, t, g, unknown or other
  misc_feature (517)..(517): n is a, c, g, or t
tcagcatagtagtgcacgaccggtgctcgatttagagtgctacgaagggaaaggggggggtctcaggaggcagggctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccngcagtgacgttggtggttataactatgtctctgtaccaacaacaccaggacaaacgcccccaaactcatgtattttgattgtcagtaatccggccctgtagggtttctaatcgtcttctctggctccaagtctgcaacacggcctcctgaccatctcgtgggctccgagctgaggacgaggctgattatactgcagctnatatacaacagcagctacttctagttagttccgggcggaaggaccagtcgtcgaccgtctacggtcaccgcccaacggtcctacgccccctntctcgtccg

SEQ ID NO: 105028 - DNA, 570 bp, Homo sapiens
  misc_feature: GYAE6OF01CFHQY.10.29.C07.1.454.CMB.1.raw
  modified_base (228)..(228): a, c, t, g, unknown or other
  misc_feature (228)..(228): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcaggtgacgttggtagttataactatgtctctggtacaacaacaccagacaaacgccccaaactcatgtattttgatgtcagtaatcggcctcgtaggggtttctaatcgcttctctggctaccaagtctaggcaacacggcctccctgacctatctcgtcgggctccgaggctaggaggacgaggtctagtatttattactgcagtctacataactaacaaccagcaagtcctactttctgtacgttcgggacggacgggaccaagtccgtacggacccgttacgtaggtacccaacggacccgaaggtccttacccggcccccgttgggtcctaacccg

SEQ ID NO: 105029 - DNA, 614 bp, Homo sapiens
  misc_feature: GYAE6OF01DIW2O.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcagtcaccatctcctgcactggaaccagcagtgacttttgtgcttataactatgtctcctggtaccagcaccacccaggacaaacgccccaaacttcctttgttttgagtacagtaacgcggcctcaggactccctgacgttcgttctctcgcctaccaagtctggaccaacgacggtccctccgtcgacccgttctcgtcgggcctccgaggctaggaggtactggaggactagtactttactacgtgaccgagccgctaattacttcgaaccggtaccccgtaaaggtggggtttcggttcggggccgggtacgggtaaccgttaagggtccgtacccgtcgttcgggaccacggacccgaggtccctcccggcccccgttcggtccacttccttccgttcccctccttccc

SEQ ID NO: 105030 - DNA, 553 bp, Homo sapiens
  misc_feature: GYAE6OF01DEI2W.10.29.C07.1.454.CMB.1.raw
  modified_base (227)..(227): a, c, t, g, unknown or other
  misc_feature (227)..(227): n is a, c, g, or t
  modified_base (400)..(400): a, c, t, g, unknown or other
  misc_feature (400)..(400): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacaacacccaggcaaagccccaaactcatgtatttttgatgtcagtaatcggcctcgtaggggtttctaatcgcttctctggctccaagtctggctaacgaccggcctccctgacctatctcgtcgggctccgnggtcgtgacggacggaggctagtattattactgcagtctcattactaacaaccagcacgtcctacttctagtagttcgggacgggacggaccagcgtacgacccgttcgtacggtccacgacccgtaacggcctcgcccccgtggtcctaccg

SEQ ID NO: 105031 - DNA, 563 bp, Homo sapiens
  misc_feature: GYAE6OF01COQPU.10.29.C07.1.454.CMB.1.raw
  modified_base (227)..(227): a, c, t, g, unknown or other
  misc_feature (227)..(227): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtaggttataactatgtctctgtaccaacaacaccaggcaaacgccccaaactcatgtatttttgatgtcagtaatccggcctacgtagggtttctaatcgtcttctctgctcagtcngcaacncggcctccctgaccatctcgtcgggcctccgaggctggaggacggaggtctagtattattactgacacgctacatactaacaaccgagcagcctacttctagttacgttccggacgggaggtacccaagtccgtcgacccgttacggtacggtccgaccgacccgaacggtccctacccggcccccgtcggtcctacccg

SEQ ID NO: 105032 - DNA, 621 bp, Homo sapiens
  misc_feature: GYAE6OF01EZB51.10.29.C07.1.454.CMB.1.raw
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttgggtggttatgtacttttgtccttcctggtaccaacagcagccgaggaccgaacgaccccccaaaattccatgtattttatgtatgtcagtgccggcggccgtcggggtcctgntcgcttcttgcctcagtcngcaacncgcctccnaccatctcgtcgggctccgagactggaggacggacgtctagtatttatacgtgactacgcctacacgaactaccgaggccgacgtaggtcggggtttggggtcggttccgggggaccgggggtaaccctaccggtaccgttaccgggtaccccggttaccggtaaccgggttccgaaccgggtaccccgaacgggtccccttacccgggccccccgttcgggtccccgttacccg

SEQ ID NO: 105033 - DNA, 630 bp, Homo sapiens
  misc_feature: GYAE6OF01BYDYH.10.29.C07.1.454.CMB.1.raw
  modified_base (227)..(227): a, c, t, g, unknown or other
  misc_feature (227)..(227): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacaacaccaggcaaacgccccaaactccttgttttgaggtcagtaacgcggccctcgaggtactccctgactcggttctctcgcctcaagtctggacaacacggcctccgtgtacccgtctcgtcgggcctccgaggtctacgggacggacggaggtccttaggtaactttacgttacgtgacctaggtcctactaagttactaacctaaaccagtaccaacgtcctactttcgtaggttacgttccggggacggtacgggaaccaggtccgtacggtacccgttccgtacgggtccacggacccgaaggtccctacccggtcccccgttacgggtaccctaccgttccgtcccgttacccccc

SEQ ID NO: 105034 - DNA, 529 bp, Homo sapiens
  misc_feature: GYAE6OF01CHSED.10.29.C07.1.454.CMB.1.raw
  modified_base (323)..(323): a, c, t, g, unknown or other
  misc_feature (323)..(323): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacaacaccaggcaaacgccccaaactcatgtatttttgatgtcagtaactcggcctntaggggtttctaatcgcttctctgctcagtctgcacacgcctcctgacatctcgtggctcgagctgaggacgagctgattattactgcagctacatataacaaccagcacgctacttctagtacgttcgggacgggaggaccaagcgtacgaccgttccgtaggtaccacgacccgaaggcctccgtccccctcgggtcctacccg

SEQ ID NO: 105035 - DNA, 671 bp, Homo sapiens
  misc_feature: GYAE6OF01AD0ND.10.29.C07.1.454.CMB.1.raw
  modified_base (244)..(244): a, c, t, g, unknown or other
  misc_feature (244)..(244): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcacgtggcaccagcagtgacagtaggtnacttataactatgtctcctggtaaccaacaaccaccacggccacggccccagacctcatctatttctgatgtcagtgacgtccggtccgtttgggtactttactaatcgtcttctctcgtccctacgtaacgttcgtcggaccaaccgtaccggtccttacccgtacgtaccacgttccgtcccgggtcctaccccgaccgtcgtacggaacggaccggacggtcctacgtactttacttacgtcgtaccgacgtcctactaacttaaccgtaaccgaacccggtacggggtaccctaccgttccgttacgttacgtacgttaccggttccggggaccgggtacggggttacccgtcggggtccgttacccggtacccggttacccggttaccgtaccgacccggtaccccggtaacgggtcccccg

SEQ ID NO: 105036 - DNA, 537 bp, Homo sapiens
  misc_feature: GYAE6OF01C8EHY.10.29.C07.1.454.CMB.1.raw
  modified_base (452)..(452): a, c, t, g, unknown or other
  misc_feature (452)..(452): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaaccagcagtgacgttggagttataactatgtctctggtaccaacaacaccaggcaaacgccccaaactcatgtattttgattgtcagtaactccggccctcgtacggggtttctaagtcgtcttctctggcctacaagtctgcaacgacggcctcctgaccatctcgtcgggctccgaggtctggacggacgaggctagtattattactgacagtctacatacacaacanacagtctacttctagtagtcggcggtaacggaccagcgtcgtacctcgtaggccacgacccaggcctccgccccgtcgtcctacc

SEQ ID NO: 105037 - DNA, 685 bp, Homo sapiens
  misc_feature: GYAE6OF01D4EGN.10.29.C07.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcatcacatctctgcacgtggaaccngcagtgtacgttggtagttataactntgtctctcgtaccaacaacaccagacaacggaccccaactcatntattttgatcgtacagtactcgcctgtaggttactatcgtcttctctcgtctcgtagtcgtcgacaacgccgtccctccctacgacctacgttccgtacggtcggtacctccgacggtcgtaggacggtacggacgtcgtaggtaacttacgtacgtcgacgcgtaccgtactaacttacgtacgaaccggtacccctaacgggtacgggttacgggttcgggacggggtaacgggtacggtaacgggtccggtacccggttccggtacggggtacccgtacccgggtaacccgtaaccgggtcccgttaccccggtaccccccggttacggttaccccgttacccgttcccgggtttacccccggttcccccgtccccgtttaccccccg

SEQ ID NO: 105038 - DNA, 622 bp, Homo sapiens
  misc_feature: GYAE6OF01DNG80.10.29.C07.1.454.CMB.1.raw
  modified_base (233)..(233): a, c, t, g, unknown or other
  misc_feature (233)..(233): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgactcacctatcctacctacacgtggaaccngcagtgtacggttgtagttataactatgtctcctaggtaccaacaaccaccacggacaaacgacccccaaactcatagtattttagattgtacagtaacgtccggtccctacgtacgggtttctaagtcgtctctcgtcgtactccaagtcgtacggacaaccgccggcccttcccacgaccctatccgtacgcggtcctccgaggccgtaggacggtacggaggtccgtagtatttaacttacgtgacgtacgtactacgtaataactaaccaacgcgacacgtcctaacgttcgtagttacgtacgggacgggacggtaaccagtcgaccgtacccgtacgtacgtcacgcccgaacggtcctccgccccgtacgtctccgtacccg

SEQ ID NO: 105039 - DNA, 553 bp, Homo sapiens
  misc_feature: GYAE6OF01BOMH5.10.29.C07.1.454.CMB.1.raw
  modified_base (251)..(251): a, c, t, g, unknown or other
  misc_feature (251)..(251): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctgtaccaacaacaccaggacaaacgaccccaaactcatgtattttgatgtcagtaatcggcctgtagggtttctatcgtcttctcgtgctcaagtctgacaacaccgcctcctcgacctatctcgtcgggctccgaggctggacggacgaggtctagtactttattacgtgacacgtctactaacgtactaacaaccgagaccacgtcctaacttcgtagtacgttcggacggacggacagtcgtcgtacccgtcgtacgaccacgccgtacgcctaccgccccgtggtctacccg

SEQ ID NO: 105040 - DNA, 701 bp, Homo sapiens
  misc_feature: GYAE6OF01AO5FZ.10.29.C07.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
tcagcatagtagtgcacgaccggtgctcgatttagagtgctacgaagggtaaggggggggtctcaggaggcagcgctctcgggacgtctccaccatggcctgggctctgctattcctcacctcctcactcagggcacagggtcctcgggcccagtctgccctcgactcacgcctccctccgcgtccgggtctcctggacncgtcagtcaccatcctcctgcacgtcggaaccnggccagtcgactttgtgcttanactatgtctctgtacagcaccaccacgacaaacgccccaactccttagttttgacgttcaagtaacgccggacctacgacggtacgtccctgtacgttcggttctactcgcctacctagtctacggacaacgtcggtcctcctacgaccgtctcgtcggtactaccgtacggtcgtggaacgtcgtacggacggtcgttacggtactttaacgtaccgttagaccgtaccggtccgtactaacgtacgtttaccgaaccgggtaccctaagggttaggggtttcggttaccggggcgggtaccgggttaaccgttaagggtacggtacccggttacgggtcgggtaccgtaaccggtccggtaacggtcccgtacccggtccccgttacggtacccgttaccgttcccggtccgttacccccgtcccgttcccgtccgttaaaccg

SEQ ID NO: 105041 - DNA, 610 bp, Homo sapiens
  misc_feature: GYAE6OF01CA0VH.10.29.C07.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (396)..(396): a, c, t, g, unknown or other
  misc_feature (396)..(396): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggaccagtcgatccaccatcctcctgcactggaaccngcagtgacgttggtagttatactntgtctctggtaccaacacgtacccaggacaaacgccccaaatgatgtatttanagnttagtcagttaacgtccgtaccctgtacggggtttcagtactcgtctttcttcgcctacgaagtctggacacgcgcctccgngacctatctcgtcggcctcgacgacgtggacggacgtagtctgtaatttactcgagctagtcctacataacgtacgaacggccggtagtcgggttacgggttggttccgggtacggggacccggggacctacgaccggtcgtacccgtcggtacgccgtaccggaccgtacggtccgtaccccggtcccgtagtccctaccgttcgttaccccg

SEQ ID NO: 105042 - DNA, 536 bp, Homo sapiens
  misc_feature: GYAE6OF01CC622.10.29.C07.1.454.CMB.1.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (420)..(420): a, c, t, g, unknown or other
  misc_feature (420)..(420): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggacccagcactgatgttgggcattataacttgtctcctggtatcaacaacgccagacaaacgcccccacactcttgatttangaagtcagtaagcgccctntagggtttctagtcgtcttctctgcctcaagtctggcaacacggcctcctgacaatctctggctcgaggctgacgacgagctagaatattactgcaanctacatatgtagagttggtctccgttctttacgtaggttttcggcgggtaacggaccgtaggctcggaccgtacgtaacgccagacccgtaacggctccgaccccctggctacccg

SEQ ID NO: 105043 - DNA, 546 bp, Homo sapiens
  misc_feature: GYAE6OF01B6ZH0.10.29.C07.1.454.CMB.1.raw
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
tcagcatagtagtgcacgaccggtgctcgatttagagtgctacgaaggggaaaggggggggtctcaggagacagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacacccaggacaaacgcccccaaactcatagtatttttgatgtcagtaatcggcctcgagggtttctaatcgcttctctggctcaagtctgcaacacgctcctnaccatcntggctcgngctgagcgngntgattatactgnagctcgaatataacaacacgacagtcacttntgtacgttcgggaccgggtaacggaccgtaaagccgtcgtaacccggtcgttacgggtccacggaccccgtaagggcctcccggtcccccgtcgtccctaccg

SEQ ID NO: 105044 - DNA, 739 bp, Homo sapiens
  misc_feature: GYAE6OF01DF9X0.10.29.C07.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (310)..(310): a, c, t, g, unknown or other
  misc_feature (310)..(310): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatcctctgcactggaaccngcagtgacgttggtagttataactntgtctcctggtaccaacagcacgccaggacgaacgaccccctaaattcaatgtatttangatgtcagtgcgccggtcccgtcggggtcctgtctcgtcttcgtcgtcggtcctaccgtaacgtcgtacggacccgaaccgtacccggtccccttccccgtacggtaaccctacgtttcccttccggttccggtcccccgttacccgacgtcccgtagggaaacgggtacgtacgggacggttccttagttaacgttttacgtttaacgtttggtttaccgccttacgttaagttacgtcggtaccggtacggggtcccggtttacccgggttcgggtttacgggggtttaccgggttccgggggaccggggtaacggggaacccgtaaacgggttcccgtacgggttacccccgggttaccggttaccgggtacccgtaccgggtaccccgaacgggttcccgtaccccgggtccccccgttaccggg

SEQ ID NO: 105045 - DNA, 669 bp, Homo sapiens
  misc_feature: GYAE6OF01DYMJZ.10.29.C07.1.454.CMB.1.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcgatcaccatctcctgcacgtggaaccngcagtgtacgttggtgtatactntgtctctgtacaacaacaccagacaacgaccccaactcatgtattttgattgtacagtaacgtccggtcctacgtagggtttactagtcgtcttctcgtcgtcctacgtagtcgtacggacaacgaccggtcctccctagacctacgttccgtcgtcgggtcctcgacggtcgtaggacgggacggtacggtacgttagtaagtttacgttacgtcgaccgtagtacttactaataactaaccgaacccgaagaccgtaacgtaccttaccgtttcgttacggttacggttaccggggtaaccgggtacgggtaaacccgtaacggtccggttaccggtacccgttacggttacggtaccgaaccggaccccggtaacgggtcccgttaccccggtcccccgttcggtcccgttaccccgg

SEQ ID NO: 105046 - DNA, 759 bp, Homo sapiens
  misc_feature: GYAE6OF01D5Y22.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtagttaatactatgtctctgtaccaacaacaccagacaaacgccccaaactcatgtattttgatgtcagtaactcggtcctacgtagggtttctaacgtcgtcctttctcgtcggtcctaccgaagttccgtacgggaccaaaccgtaacccggtccctccccgtacgtaaccctacgttccttaccggttccggggtccctacccggtacgggtccctaggggtaaacggggtacccggtaacggtaccgtttaagggtaacttttaagtttaaccgttcgggaaccgtacggtacccttacgtaacgttaactaacccgtaaacccgacgtaaccgtacgtaccgttaccgtttacgttacggttacggttccggggtaacgggaacgggtaaacccaacgggtaccggtccgtaaaccccggttccggttaaacgggtacccgtaacggaaccccccggtaacgggtaccccgttaccccggtccccccggttccgggttacccttaacccccgg

SEQ ID NO: 105047 - DNA, 605 bp, Homo sapiens
  misc_feature: GYAE6OF01BV4UQ.10.29.C07.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctggtaccaacacaccaggcaacgccccaaactcatgtattttgatgtcagtaactcggcctcgtagggtttctaagtcgtcttctcgtggcctcagtctggacaacgaccgcctccctacgaccatctccgtggggcctccgaggctagggaggacggaggtctagtactttattacgtcgctacgcctactataactaacaacgacgaccacgtaccttacttcgttagttacggtccgggacgggaccgggtaaccgaacggccgtaccggtacccggttaccgttacggacccgacggaacccgtacggtcccgaccccggtcccccgtcggttcccctacccg

SEQ ID NO: 105048 - DNA, 633 bp, Homo sapiens
  misc_feature: GYAE6OF01CQGCO.10.29.C07.1.454.CMB.1.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (384)..(384): a, c, t, g, unknown or other
  misc_feature (384)..(384): n is a, c, g, or t
tcagcatagtagtgcacgaccggtgctcgatttagagtgctacgaagggaaaggggggggtctcaggaggcagcgctctcgggacgtctccaccatggcctggctctgctattcctcaccctcctcactcagggcacgagggtcctgggcccagtctgccctgactcagcctgcctcgtgtctgggtctccgtggactagtcgatcaccatctcngctactggaaccngcagtgtacgttggtagttatactntgtctcgtgtaccaacacaccagacaacgaccccaactcactgtacttttgatgtacagtaacgtccggtaccgtacgtacgggtttactacgtcgtcttcttcgtcgtcctacgaacgtcgtgtaccacncggtacctccctacgtactactctcgtcgccgtccgaggtcgttacggacggtacggacggtacttagtacttacgttactcgacgtagtacctactaataactaacaaccaacgcctaacgtcttacgttacgttacgttacggtcgggtacggtaacgggtacctaggtccgtacggtacccgttacggtaccggtacacccgacccgtaacggtcccgtcccgtaccccgtcggtacccttcccgg

SEQ ID NO: 105049 - DNA, 829 bp, Homo sapiens
  misc_feature: GYAE6OF01B8TDN.10.29.C07.1.454.CMB.1.raw
  modified_base (252)..(252): a, c, t, g, unknown or other
  misc_feature (252)..(252): n is a, c, g, or t
tcagcatagtagtgcacgaccggtgctcgatttagagtgctacgaaggggaaagggggggggtctcaggaggcagcgctctcgggacgtctccaccatggcctggctctgctattcctcaccctcctcactcgagggcacgagggtcctgggcccagtctcgccctgactcagcctgcctcgtgtctgggtctctggacagtcagtcacctatcctctgacacgtacggaaccagcagttgtacttttggtntacttaataactattcgtactcgtacgtaccacgtaccaccaccgacgaaccaaaccgtaccccctaaactttccgttttggttttacggaggttaccaaggttaacggcccggtaccctacggaacggtaccgttccccgtaggtacgtttcccggtttcctccgttccgtacccttaaccgtaaggtccgtacggaacccaaaccggtcccggtccccgttacccgtcggtacccgtccgttccggtcgggtcctaccgggacggtccggttaggaacggtacgtacgggtaacgggtcttaacggtttaaacgtttacccgttaacgttcgggaaccgtacggtaccgtacttaacgttaccgtttacccggaacccggtaaccccggttaagggtacgggggtttacgggtttcggggaacccgggggttaacgggtaacggttaaccggggtcccgtaaccgggttcccggtacgggaccgtacccgggtacccggaacggtcccgtaccccggtccccggttcggtacccttacccggttcccgttccccggttccccctccccgtacccg

SEQ ID NO: 105050 - DNA, 632 bp, Homo sapiens
  misc_feature: GYAE6OF01DTZNL.10.29.C07.1.454.CMB.1.raw
  modified_base (200)..(200): a, c, t, g, unknown or other
  misc_feature (200)..(200): n is a, c, g, or t
  modified_base (416)..(416): a, c, t, g, unknown or other
  misc_feature (416)..(416): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacaggggtcctgggcccagtctgccctgactcagcctgcctccgtgtctgggtctccgtggacngtcatcaccatcctcctgcacgtcggaaaccagcagtgacgttggtgttatactatgtctctgtaccaacaaccaccagccacgccccagctcatctattctgatgtcagtgtacgtccggtccgtttggtactttctaagtcgtctttctctcgcctactaagtcgtgacacgccgccctcctcgaccgttctcgtcggcctcgaggtctgagtntaggcgtctagtacttactacgtcgacgacgccgtactagttacgttcccgaaccggtaccccgtaaggttacggggttcgggtttacgggccgggtaccgggttaacgtaaaccgggtcggtaacccggttccggtacggggtaccgtaccgggaccccgtaacgggtcccgttcccggacccccgttcggtaccctccgttcccgttaccccgg

SEQ ID NO: 105051 - DNA, 669 bp, Homo sapiens
  misc_feature: GYAE6OF01CGA7V.10.29.C07.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (371)..(371): a, c, t, g, unknown or other
  misc_feature (371)..(371): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctctgcactggaaccngcagtgacgttggtgttataactntgtctcctgtaccaacaacacccaggacaaacgccccaaactcatgtatttttgactgtacagtaacgtcgcctgtacgggtttctaatcgcttcgtctcgcctacgtacgtctggacaacnccggtccctccctacgacctcttctcgtcgggcctccgacggtcgtacggagggacgaggtcttagactttattcgtcgctagcctacacttaaccgaacctaaaccgagtaccgacgtaccgttactttaccggttacgttaccggtttccgggaaccggggtaccgggtaaaccgtaaccggtaccgttacccgggtaacccgttcccggtttaaacgggtacccgaaacccggtacccccggtaaggcccccggttaccccggccccccggttacccggtcccgtttacccccgg

SEQ ID NO: 105052 - DNA, 796 bp, Homo sapiens
  misc_feature: GYAE6OF01DMF5U.10.29.C07.1.454.CMB.1.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
tcagcatagtagtgcacgaccggtgctcgatttagagtgctacgaagggaaaggggggggtctcaggaggcagcgctctcgggacgtctccaccatggcctggctctgctattcctcacccctcctcactcagggcacgagggtcctgggcccagtctcgccctgactcagcctncctccgtgtctgggtctcctggacngtcgatcaccatcctcctgccacgtacggaaccngccaggtcgtacggtttgggtaggtttaataactattcgtctccgtacggtaaccaaacaaaccgacccgaggaccaaaaccgacccctaaactctattagttaatttttgagttgtacaacggttaacgtccggtacccgttaggtacggggtttactaacgtccgttcctttcgtccgttacggtccttaccgtaaaggttccgtacgggaactaaacccggtaccggttcccctacccgtacgaaccctattccgttacggtcggggtaccttaccggcgggtaccgttacgggaaacggggtaaccggacgggttaccttaaggtttaacgtttaacgttaacggtcgaccgtaacgtccttaccaaactttaaccgtaaccgaaacccgaagtaaccggtaactaccgttactttccgttaggttacggttccggggaaccgggtaacgggaacccgtaaggtcccgttaccggtaacccggtttacggtaccgtacccgaaccggtacccgaaaccggtccgttaccccggtacccccgttcggtcccgtaccccg

SEQ ID NO: 105053 - DNA, 772 bp, Homo sapiens
  misc_feature: GYAE6OF01A5X1Q.10.29.C07.1.454.CMB.1.raw
  modified_base (227)..(227): a, c, t, g, unknown or other
  misc_feature (227)..(227): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttataactatgtctcctgtaccaacaacaccaagacaaacgacccccaaatcatgtattttagattgtactagtaactccggcccttcgtaggggtttactaactcgtcttcgtcgtcggtacctaccgtaagttcgtacggaccaaaccgtaccggtccccttacccgtacgtaaccctacgttccgttccggtcggggtaccctacccggaagggtccgttagggaacggggtaccggtacgggtacttaggttaactttaacgttacgtacggtccgtaacgtccttaccgtaattaacctaaacccgaacccgtacggtaccctaacggtacccttaaccgttttcgtacggtttaaccggttaccggggaaccggggtaaaccgggtaacccgtaaacgggttcccggttaacccggtaaccccggttaccgggttaaaccggtacccggtaacccggacccccgtaaacggggtcccccttacccccgggtcccccccgttacgggttccccttaacccccgg

SEQ ID NO: 105054 - DNA, 527 bp, Homo sapiens
  misc_feature: GYAE6OF01B1247.10.29.C07.1.454.CMB.1.raw
  modified_base (227)..(227): a, c, t, g, unknown or other
  misc_feature (227)..(227): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacaacacccaggcaaagcccccaaactccatgtatttttgatgtcagtaatcggcctcagggtttctaatcgcttctctcgctcaagtctgcaacacggcctcctgacctatcctcgtgggcctccgacggtctaggagacgaggctgatttatactgcacgctcatactacaaccagcagtcacttctagtagtcggcggacggaccagcgtcgtaccgtctaggtcacggccaacggtcctagtccccttggcctaccg

SEQ ID NO: 105055 - DNA, 776 bp, Homo sapiens
  misc_feature: GYAE6OF01AHVPJ.10.29.C07.1.454.CMB.1.raw
  modified_base (197)..(197): a, c, t, g, unknown or other
  misc_feature (197)..(197): n is a, c, g, or t
  modified_base (327)..(327): a, c, t, g, unknown or other
  misc_feature (327)..(327): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctctcactcagggcacgagggtcctgggcccagtctgccctgactcagcctgcctcgtgtcgtggtctcgtggacngtcgatcaccatcctctgccactggaaccagcagtgtacgttggtacgtttataactatcgtcctccgtacgtaccaactaaccaccgaggaaccaaaccgcccctaaactctatagtttatttagactntactagtacgtcgtacctcgtacggttactactcgtcttacgtcgtcgtacctaccgtaacgtctacggtacctaaccgtccggtaccctaccgtacgtaacctacttcccgtacggttcgggtacctaccggaggtccgttaggaacggtacggtacgggtacgttacggttaacttaacgttacgtcgacgtacggtacctaacttaacttaaacgtaaacccgtaaaaccgtaaccgttaaaactttcgggttaacgttaaccgttaaccggttaccggggtaaccgggtaaaccggtaaaccttaaacccggttccggttaaaaccccggttacccgttttacccggaaccgtaaccggtaccccgtaacggttcccccgttaaccccgggtttccccccgtaacggttaccctcccgttttacccgtccccggttacccccccg

SEQ ID NO: 105056 - DNA, 571 bp, Homo sapiens
  misc_feature: GYAE6OF01CABAE.10.29.C07.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
tcagcatagtagtgcacgaccggtgctcgatttagagtgctacgaagggaaaggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataaactntgtctctggtaaccaacaacaccaggcaaacgaccccaaactcatgtattttgatgtcagtaatcggcctcgtagggtttctaatcgtcttctctcggctccaagtctggacaacacggcctccctagaccatccgtctcgggcctccgacggcgtaggacggacgaggctagactttattacgtgacagctacattaactacaacctacgcacgctacttgtagtagtcggacgggacgggaaccaagccgtacggtaccctaccggtaggtaccgacgaccccgtaaggtccctacggtcccccgtcgtccgtacccg

SEQ ID NO: 105057 - DNA, 652 bp, Homo sapiens
  misc_feature: GYAE6OF01AZZHQ.10.29.C07.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaaccngcagtgacgttggtgttataactntgtctctggtaccaacacaccagacaacgcccctaactcttagttttgacgtcagtagccgtcctcgacgacgtcctgacgtcgttctctcgcctactaagtctacggacaaccgcggtcctcctacgacctacgttccgtccgggcctacccacggcgtacgacggtacgacggtctactaacgttacgttactgacacgtctactactacctaaccgaaccgacgggtactaccgtcgttacgtagtacgttacggttccgggacgggtaccgggtaccgtcggtccgttacggtaaccccggttccgttaaccggtaccgacccggtacccgtaaccggtcccctacccggtccccccgttacggtacccctaaccgttccccgtcccgttaccccccg

SEQ ID NO: 105058 - DNA, 705 bp, Homo sapiens
  misc_feature: GYAE6OF01CICE0.10.29.C07.1.454.CMB.1.raw
tcagcatagtagtgcacgaccggtgctcgatttagagtgctacgaaggggaaagggggggggtctcaggaggcagcgctctcgggacgtctccaccatggcctgggctctgctattcctcaccctcctcactcagggcacgagggtcctgggcccagtctcgccctgactcagcctgcctccgtgtctgggtcctccgtggactagtcgatccacctatcctcctgcctacgtacgggaaacccagacctaggttggtacggtttgggttacggtttaactaaacgttagttcgttaccttccgttacggtaacccaaaaccaacccaacccgaaggaccaaaaccgaccccctaaaactctattagtttatttttgatacgtacagtaacgtccggtcccttgtagggtttactaacgtcgtcttctcgtcggtcctacgaacgtcgtcggacaaccgccgtaccctcctacgacctactccgtcgtcggtcctcggacggtcgtacggacggacgacggtcttaagtactttactactcgcctacgactacgtaactaacaccaacctacgactacgtacctacgtttcgtacggttagtaccggggacggaacgggaccctaggtccgtacggtacccgtacgtacggacctaccggtacccgacggtaccctcccggtacccccgtcgtacccgttacccg

SEQ ID NO: 105059 - DNA, 660 bp, Homo sapiens
  misc_feature: GYAE6OF01CQZQP.10.29.C07.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
tcagcatagtagtgcacgaccggtgctcgatttagagtgctacgaaggggaaagggggggggtctcaggaggcagcgctctcgggacgtctccaccatggcctgggctctgctattcctcaccctcctcactcagggcacgacgggtcctgggcccagtctgccctgactcagcctgactccgtgtctgggtctcctggacagtcgatcaactatctcctgcactggcaccagtcagngacagtaggtntacttaataactatcgtctaccgtagtaaccaaacgaaccaaccgacgccacggcccccaagacctcactctactttactgatgtacagtgacgtccgggtaccgtttagggtactttactaacgtcgtcttcctctcgtacctcaagtctacgactaacgcgtcttccacgtacctacgtccgtccggtaccttccacgtacggtacggacggaacggtacggtacttaacgtaattttaaccttaacgacgtacctacggtaccctactaacgttaaacctacccggaaccggaggggaccctacgtacgtaccggttagtaccgttacggtacgggaacgggacgggtacgtcggtaccggtacgtaacccgtccgtaaaccgtcgaaccgtacccggtaacgtcccg

SEQ ID NO: 105060 - DNA, 673 bp, Homo sapiens
  misc_feature: GYAE6OF01EVYEE.10.29.C07.1.454.CMB.1.raw
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacngtcatcaccatcctctgcactggaaccagcagtgacgttggtagttataactntgtctctggtaccaacaacaccagacaacgaccccaatcatagtattttgatgtctagtactccggtcctagtacgggtttactagttcgcttctcgtcgtctacgtaagtccgtacggaccaaacgtccggtcccttacccgtacgaacccgtagtcctcgggtcgggccctaccggacggttcctagggtacggaaccggagggtaccttaggtactttaaacgtcgtacgtacgtacctagtactaaccttacgaacctaaccgaggacccacgtacccgtttacttacggtacgttacggtaccggacggggtaaccgggtaccgaacgttcccgtacggtaacccgttacgtaaccggtccgaaccggaccgtaaccggttcccgtaacccggtcccccgttgtccctaccccgg

SEQ ID NO: 105061 - DNA, 613 bp, Homo sapiens
  misc_feature: GYAE6OF01D5Z8J.10.29.C07.1.454.CMB.1.raw
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (339)..(339): a, c, t, g, unknown or other
  misc_feature (339)..(339): n is a, c, g, or t
  modified_base (424)..(424): a, c, t, g, unknown or other
  misc_feature (424)..(424): n is a, c, g, or t
tcagcatagtagtgcacgaccggtgctcgatttagagtgctacgaagggaaaggggggggtctcaggaggcagcgctcgtcgggacgtctccaccatggcctgggctctgctattcctcaccctctcactcagggcacagggtcctgggcccagtctgccctgactcagctgcctcgtgtctggtctctggacagtcgatcaccngtctcctagcactggaaccngctagtgacgttggtagttanactntgtctctggtaccaanacaccagacaacgccccaagtcatcgtattttgatgtctagtatccggcctcgtagggttctaatcgtcttcnctggctacagtcgtggcaacacgtcctcctgacctatctacgtggcctcgacgctaggacggacgaggctagactttatacgttncgtagcttacgattacaacgaacctacggacctagtaccttaacgtttcgtagtttacggttaccggggaacggaacgggtaaacccgtaaacggtccgttaccggtacccggttaccgttaacgggtacgaccgtaaccccggtacggtacccgttacccggtccccccgttagggtcccttacccgg

SEQ ID NO: 105062 - DNA, 622 bp, Homo sapiens
  misc_feature: GYAE6OF01COC7Q.10.29.C07.1.454.CMB.1.raw
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (451)..(451): a, c, t, g, unknown or other
  misc_feature (451)..(451): n is a, c, g, or t
  modified_base (501)..(501): a, c, t, g, unknown or other
  misc_feature (501)..(501): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctcgtgtctgggtcctcctggacngtcatcaccatctcctgcacgtaggaccagcagtgtacgtttggngttactaactatgtctccgtacgtaccaaacaacaccaggacaaaccgacccccaaactccatcgtagtttttanagttacgtactaagtacgtccggcccgttacgtacggggtttactaactcgtctttctctgcctacagtcgtcggacacgaccggccctcctacgacctactctcgtcggcctccgagcgtggaacggacgngtactagtacttaagttcgtgtacgctactacgactaacgtacaaccganaccgaacgtctaaccttcgttacgtgttccggacgggtacggaccaggtccgtacgaccgttccgtacggcgtaccggacccgtaaccggtcctccccggccccgttccggtacttccccg

SEQ ID NO: 105063 - DNA, 934 bp, Homo sapiens
  misc_feature: GYAE6OF01DMIYQ.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcaggcacgagggtcctgggcccagtctgccctgactcacgcctgcctccgtgtctgggtctccgtggacagtcgatcaccatcctcctgacacgtacggaaccagctaaggtggtacggtttgggtaggtttaataaccgttattcgttccttaccgtacggtaacccaaaccgtaaacccgaaccccgaacggaacccaaaacccgaccccccaaaacttccgtaagttacggtttaatttttagtacgttagtaccgtaaaggttaaccgttcccggtacccgttaacggtttaacggggttttacctaaacgttccgtacctttcgttccgttacggtacccgttacccgtaaaccggttccgtaacgggtaaccgtaaaccccggtacccggttaccccctccccgttaccgaaccccttaacgtttcccgttaccggttccgggtaccccgttaccggacggtacggttacgggaacgggtaacggtcggtaccttaggttaactttacgttaccgagtaccgtacggtacctaacgtaacgtaacttaacccgaaacccgacgtaacccgtacggttacccgttacccgttttaaccgttaacggtttaccggggttacccgggaacccgggggtaaaccggtaaacccgtaaccgggtacccgttaacccgggtaacccccggtttacccgggttaaacccggttaccccggtaaaccccgggtaccccggtaaaccggggttccccctaacccccggggttcccccccgttacgggtttacccccgttaaccccgg

SEQ ID NO: 105064 - DNA, 722 bp, Homo sapiens
  misc_feature: GYAE6OF01AFOWO.10.29.C07.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
tcagcatagtagtgcacgaccggtgctcgatttagagtgctacgaagggaaaggggggggtctcaggagacagcgctctcgggacgtctccaccatggcctgggctctgctattcctcaccctcctcactcgagggcacagggtcctgggcccagtctgccctgactcagcctgcctcgtgtctggtctcctggacagtcgatcacatctcctgcacgtggaaccngcagtgtacgttggtgttanaactntgtctctgtaccaacaacaccagacaacgccccaatcatgtnttttgatgtcagtacgtccgccttcgtagggtttactaagtcgtcttctcgtcgtctacgagtcgtacgacgaacgtaccgtcctccctcgacctacgtccgtacgtcgggtcctaccgacggtcgtacggacggtaacggtaggtacgttagttaacgtttacgttaacgtcgtaccgtaacggtccttaacgtaacttaaccgtaaccgaaacccgtaacgtacccgtaacgtaaccgtttaccctttacgttaggttaaccgggttacccgggggtaccgggtaaacccgggtacccggtaaacggttcccggtaaaccgggtaccccggttaccgggttaaccggtacccggtaaacccggacccggtaaaccgggtccccgtaaccccgggttccccccgtttacgggtccccgttaaccccgg

SEQ ID NO: 105065 - DNA, 778 bp, Homo sapiens
  misc_feature: GYAE6OF01DKBJQ.10.29.C07.1.454.CMB.1.raw
  modified_base (223)..(223): a, c, t, g, unknown or other
  misc_feature (223)..(223): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctctcactcagggcacgagggtcctgggcccagtctgccctgactcagcctgcctcgtgtctggtctcctggacagtcgatccacatctctgcactgaaccngacagtcgacgttggtagttataactatcgtctcgtggtaccaacgaacaccaggacaaaccgaccccaaactcattgtacttttgattgtacagtaacgtccgtacctcgtagggtttactaacgtcgtcgttctacgtcggtctaccgtaacgtccttacggaccaacgaccggtccctacccgtcgaacctacttacgtccgttcgggcctaccgaggtccgtaggaacggtaacggaggtacgttaggaacttttacgtacgttcgacgtacggtaccttacgtaacttaactaaacccgtaaacccaggtaacccgtacgtacccgtttaaccgtttacgtttaacccgggttacggtttacccgggggaaaccggtttacccggggaaaccgttaaacccgggtaccggttaacccgggttaaaccccgggttacccggtttaaaccgggaaccccgtttaaaccgggacccccgggtaaacccggggttaccccgttaccccggttaccccccccggggttaaccgttccccgtttaaaccccccggg

SEQ ID NO: 105066 - DNA, 816 bp, Homo sapiens
  misc_feature: GYAE6OF01CZ1BK.10.29.C07.1.454.CMB.1.raw
  modified_base (139)..(139): a, c, t, g, unknown or other
  misc_feature (139)..(139): n is a, c, g, or t
  modified_base (235)..(235): a, c, t, g, unknown or other
  misc_feature (235)..(235): n is a, c, g, or t
tcagcatagtagtgcacgaccggtgctcgatttagagtgctacgaagggaaaggggggggtctcaggaggcagcgctcgtcgggacgtctccaccatggcctgggctctgctattcctcaccctctcactcagggccanacgggtcctgggcccagtcgtgccctgactcagcctgcctcgtgtcgtcggtctccgtggacagtcgatccaccatcctctgcacgtacggaaacngcgagtcgacggttggtagttactaatgttgttcctaccgtacggtaaccaaacgaaccaacccgagggaaccaaacccgtaccccctaaactcttagtaggtttattttaggattcggtactaacggtaccgttccggacccttcgggttaacgggttcttaacgtcgttactttcgtacgtcggttactaccgtaagtccgttcggaaacgtaccggtaccgttccccgtccgtaacgtcctaaccggttcgtaccgggtaccgtaccgtacccgggaggtaccgtaacggggtacggaacgggtcgttaacgggttacgttaaacgtttaccgttacgtacggtaaccgttacgggacctttaaaccaacgtttaaccgaaccgtaaaccgaacggtaccgtaacggtttcccgtaaggttttacccgtaaccggtttacgggcccggggaaacgggtaaaccggtacccggttcggtaaaccgggtccggtaaaacccggttcgtaacgggttaccccgaaccgacccgtacgggttaccccgtcccgtaccccgggttagtcccgtttaaccccgg

SEQ ID NO: 105067 - DNA, 686 bp, Homo sapiens
  misc_feature: GYAE6OF01EVXCL.10.29.C07.1.454.CMB.1.raw
  modified_base (199)..(199): a, c, t, g, unknown or other
  misc_feature (199)..(199): n is a, c, g, or t
  modified_base (361)..(361): a, c, t, g, unknown or other
  misc_feature (361)..(361): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcaggacacgagggtcctgggccctgtctgccctgactcagcctgcctccgtgtctgggtctcctggacngtcggtcaccatctctgcactcgacccagcatgatgttggctattataccttgtctccgtggtactacaacaacgccaagaccaaaccgcccccactacctcttagtatttactggaagtacaggtaacgccggcctcggtacgggtttctagtcgtacttntcgtgcctactaacgtcgtcgtacaacgtaccgtccctaccgtagaaccgtaacttcgtcgtcgggtctaccgacggtctacgggacgacggacgtctaacggtaattactttacgtacgactagtcccttaatacgtaagtgtaagtacgtacggttccgtaccgttttactttaacggttaaccggggtttcgggaccggggtaaccgggtacccggtacgggttacccgtacggtaaccccgggttacgttaacgtacccgtaaccggtaaccccgtacgggtaccctccccgggcccccggtttcgggtacccttacccgg

SEQ ID NO: 105068 - DNA, 813 bp, Homo sapiens
  misc_feature: GYAE6OF01A68Q2.10.29.C07.1.454.CMB.1.raw
  modified_base (141)..(141): a, c, t, g, unknown or other
  misc_feature (141)..(141): n is a, c, g, or t
  modified_base (186)..(186): a, c, t, g, unknown or other
  misc_feature (186)..(186): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacgngggtctgggcccagtctgcctgactcagcctgccttccgtgtcgnggtactccgtaggacagtcgactcacctacttcctcgtacgactacgtacgggaaccagacgtacggttacggttcggtttaggggttacggtttaaacttaaacgttcgttccggttacctttacccggttaacggttaaccccaaaaacccgtaaaaccgtaccccggaaacggggaaccaaaaccccggtaaccccctaaaacgtccgtacgttacggttagttttttacggaactttcggtaacgttaaccggtaacgtcccggtaccgttacgggttacggggttttacctacggttccgttaccgtttctaccgtcgtccgtaacgtaacggttcgtacggaccaaaccgggtcccgaccgtttaccgacgtaacttacgtccgtcggtacggcgtaccggacgctacggacgtacggtacgtacgtaacgttacttacgtcgtacgacgtactacgtaatggtactagggtagtggtaccgtccttacggtttaccgtacggtacgggttcggaccggtacgggtacgccggtacctccggttaacgtaccggttacgacgtaccggaccccggtcggtacccgttacccgtaccccggtactacgttccccggtacccc

SEQ ID NO: 105069 - DNA, 889 bp, Homo sapiens
  misc_feature: GYAE6OF01BZTJK.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctcgccctgactcagcctgcctccgtgtctgggtctccgtggacagtcgactcaccatcctcctgccactcggaaccagccaggtcgtacggttgggtacgttaataactattcgtcctccgtacggtaaccctaaaccaaccgacccgaacgggaacccgaaaaccgaccccccctaaaacgtacctaacgtttagtttaacgttttttggaacgtttcggtaacgtaacggttaaaccggttcccgggtaccccgttacgggttaacggggtttttacctaacggttcccgttacctttccgttccgttacggtacccttacgtaacgttccggtacggaccgtaaccggaccggtccccttacccgaccgtaccgtaccttccgtacggttccgggacccgttacccggtacgggtccgtacgggaaccgggtaacgggtacggtaccgttaacggttaacttttaacgttaccgttacggaccgttaccgtacctaccgttaaactaaccgttaaacccgaacgtaaccggtaccctaccgttacccgttaccgttttaccgttacggttaccgggttacccgggggacggggttaacccgggaaccgtaacggtcccggttacccgggtacccggtttacccggtaccgggtaacccctacccggggaaccccgtacgggttcccccgtaccccgggttccccccgttaccggttccccttacccccgg

SEQ ID NO: 105070 - DNA, 761 bp, Homo sapiens
  misc_feature: GYAE6OF01D0AIJ.10.29.C07.1.454.CMB.1.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctctcactcagggcacaggtcctggcccagtctgcctgactcagcctgcctcgtgtcgtggtctcgtggacagtcgatcgaccntccgtctgcacgtgaaccngcagtcgtacgttggtagttaataacgtgtcgtccgttccgtacggtaacctaacaaccgacccgaggaactaaaccgacccctaaagtctaagttcgttagtttttgacttacgtacgtaacgttaacgtccggtcccttaggtacgggtttactaacgttcgtacttcgtcgtacggtcctaccgtaagtccgtacgaccgaaaccgtacccggtacccttacccgtacgtaaacccgtcgtttcctcggttaaccgggccgttaccgaccgggtcgttacggaacgggtaacgtcgggtacttagttaacgttacgttacgtacgacgtacggtccttaactaacgtaaccgtaactaacccgagacccgtaacgttaccctttactttacgttacgggtttacggtaaccggggtaaacggacggtaaacccaagggttaccgtaccggttaaccccgttacgtacggtacccgtaccggaacccgtaccggttaccccttccccgggtacccctttcgggccttaacccccgg

SEQ ID NO: 105071 - DNA, 909 bp, Homo sapiens
  misc_feature: GYAE6OF01D4OGF.10.29.C07.1.454.CMB.1.raw
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacgacgggtcctgggcccagtctcgccctgactcacgccctccctcgcgtccgggtctccgtggacagtcagtccaccatcctcctgcacgtaggaaccagctagtgtacttttgtacgtacttaagtactagtcgttcctaccgttacggtaccacgtaccaacccgaacccgaacggaaccaaaacccgtacccccttaaactttccgttttaggtttttacggacggttaccgtaaggtaacggcccggtaccctaggacggtaccgttcccgtagttaccgttccggtttactcgtacgtacccgtacgtaacgttcggtacgaacctaacccgtccggtcccttacccgtcggtaacccgttcgtcggtaccgggaccttacccgggacggtacgtagggtaaggtacggtacggtaccggttacgtaacggttaactttacgtaccgtacgaccggtacgtacccgtaagttaacttaaccgttacccgggaacccgggttaaccccggtaaggggttaccgggggttttacgggttacccggggggaaccggggttaaaccgggggttaaacggttaaccggggttacccggtaccccgggtttacgggggttacccggtaccccggtaaaccggggtacccccggtaaaccggggttccccctaccccgggttaccccccggtacggtttaccccttccccgttttacccggttaccccccgtttaaccccccgtaccccttacccgtaacccgtttaaacccg

SEQ ID NO: 105072 - DNA, 581 bp, Homo sapiens
  misc_feature: GYAE6OF01EJPOQ.10.29.C07.1.454.CMB.1.raw
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcaggacacagggtcctgggccctgtctgccctgactcagcctgcctccgtgtctgggtctcctggacagtcggtcacatctcctgcacgtcggacccagcactgatggttggctattataccttgtctctggtancaacaccgccagacaacgccccacnctctgtatttatgaagtcagtacgccggtcctgtagggttctagtcgtcttctctcgcctactagtctcgacacncgtcctcccgagactatcgtcgtcggctccgaggctacgacggacgacgtagtagaattacttacagctacgctactagtgtagtacgtagttggtacttccttcgtttacgttagggttccgggacgggtacggaccgtaggtcgtaccgtaccggtacgtaacgtccgaccggtacccacgggtcctacccggtccccgttcgtccttacccg

SEQ ID NO: 105073 - DNA, 756 bp, Homo sapiens
  misc_feature: GYAE6OF01BRWR7.10.29.C07.1.454.CMB.1.raw
  modified_base (200)..(200): a, c, t, g, unknown or other
  misc_feature (200)..(200): n is a, c, g, or t
tcagcatagtagtgcacgaccggtgctcgatttagagtgctacgaagggaaaggggggggtctcaggaggcagcgctctcgggacgtctccaccatggcctggctctgctattcctcaccctcctcactcagggcacagggtcctgggcccagtctcgccctgactcagcctgcctccgtgtctcgggtctccgtggacngtcgatccaccatcctccgtgactactacggaaccagcacggtgtacggttggttagttaattaacgtagttcgtcctccgttacggtaaccaaccaaccaacccagaccaaaccgacccccaaacgtctattcgtaattttcgagttcgtacgtaacgttaacgtccggtacccgttacgttaacggggttttacttaaacgttccggttacctttacgttccggtacggtaccgttaccgtaaaggttccgtaccggacccgtaaaccggaccccgttccccgttaccccgtacgtaccctaccgttcgttaccggtccgggtacgtacccggtacgtacgggtagaaccggggtacgacgggtacttaacggttaacgtttacgttaaccgtcggaccgtacctaccgtagtacgtaaacttaaccaaccgtaacgccgtaacgtccttaacgtttcttaaggttccgtaccggagggaccggtactaccgtcgtacgtacccgtggtacgacccacgacgtacgcccgtacccgtcccgtccgtaagtcccg

SEQ ID NO: 105074 - DNA, 694 bp, Homo sapiens
  misc_feature: GYAE6OF01A8XSS.10.29.C07.1.454.CMB.1.raw
  modified_base (255)..(255): a, c, t, g, unknown or other
  misc_feature (255)..(255): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtcgtgggtctctggacagtcgatcacctatctcctgcactggaaccagcagtcgacgttgggtagttataactntacgtctcgtacggtaccaactaaccaccgaggaccaaacacccccgaaatcatgtagttttgatgtcgtaagtaacgtccggtacccgtaggtaacggggtttactaacgtccgtacgtttaccgtcgtacggtacctaaccgtaacggttacgtcggaacgtaaaccgtacccggtacccctacccgtaccgaacctaccgttccgtaccggttcgggaccctacccggtagggtcctaacgggtacgggaacgggtacgtcgttaacgtatttacgttacctaggctacggtctacgtaatactaactaacgacaccgtacgtacttactttcggtacgttacggtacgggacggtaacggaccgaacgtcgtacggtacccgtcggtaagcgaacctaccggacgtccgtacccgccccggttagccgttacccg

SEQ ID NO: 105075 - DNA, 753 bp, Homo sapiens
  misc_feature: GYAE6OF01DGF9O.10.29.C07.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcgagggcacgagggtcctgggcccagtctcgccctgactcagcctgcctcgtgtcgtgggtctcctggacngtcgactcaccatcctcctgcacgtaggaaccngccaggtcgtacggtttgggtaagttactaaacgtagttcgtccgttaccgtacggtaaaccaaaaccgtaaaaccgaaccccgaaacggaaccgaaaaccccgaacccccctaaaacttcctaagttgtttaacgtttttagaagttcgttacgttaacgttacgttcccgggtcccttacgggttacgggtttactaacgttcgttcttcgttcgtcgtcctacgtacgtcgagtaaccaccgtaccggccctccgtacgaccgtattccgtcgtcggacctaccgtacggacgtaggaacggacggtgacgttagtacgtttactcgtacggctacgcttaacgtaataacgtaaccaaccgacgtaccgtacgaccgtttaccgttataccggggttacgtaccggggaacggaccggaaccgacgtaccgtaacggttacccggtacggtacgttacccgacgtaaccccggtaccgttacccggtacccgttccccgtcgtcccgttaccccg

SEQ ID NO: 105076 - DNA, 502 bp, Homo sapiens
  misc_feature: GYAE6OF02I8I2B.10.29.C07.1.454.CMB.1.raw
tcagcatagtagtgcacgaccggtgctcgatttagagtgctacgaagggaaagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccagctgagcgagctgattattactgcagctcatatacaaccagcagcacttctgtattcggcggaggaccaagctgaccgtctagcagcccaaggcctcgcccctggtctaccg

SEQ ID NO: 105077 - DNA, 505 bp, Homo sapiens
  misc_feature: GYAE6OF02HLBXK.10.29.C07.1.454.CMB.1.raw
  modified_base (448)..(448): a, c, t, g, unknown or other
  misc_feature (448)..(448): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacaacaccaggcaaagcccccaaactcatgattttgatgtcagtaatcggccctcgaggggtttctaatcgcttctctggctccaagtctggcaacacggcctccctgaccatctctgggctccgaggctgaggacgaggctgattattactgcagtctcatatacaaccagcagctacttntgtatcggcgagggaccaagctcgccgtctaggtcagccaggcctcgcccctgctcg

SEQ ID NO: 105078 - DNA, 516 bp, Homo sapiens
  misc_feature: GYAE6OF02HM7MU.10.29.C07.1.454.CMB.1.raw
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattatactgcagctcatatacaaccagcagcacttctgtattcggacggtaggaccaagcctggaccgtcctaggtcagcccaaggcctcggccccctggtctaccg

SEQ ID NO: 105079 - DNA, 511 bp, Homo sapiens
  misc_feature: GYAE6OF02FZ1T0.10.29.C07.1.454.CMB.1.raw
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcgaggaccaagctgaccgtctaggtcagcccaaggcctcgccccctcggtctaccg

SEQ ID NO: 105080 - DNA, 517 bp, Homo sapiens
  misc_feature: GYAE6OF02GAXO0.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacaccaggcaaagcccccaaactcatgattttgatgtcagtaatcggccctcaggggtttctaatcgcttctctggctcaagtctggcaacacggcctccctgaccatctctgggctccaggctgaggacgaggctgattattactgcagctcatataccacccgagggcactctcgtgatagttcggcggaggcctggcgtcgaccgtctacgtcacgcccaaggcctcgccccgtcggtctaccg

SEQ ID NO: 105081 - DNA, 505 bp, Homo sapiens
  misc_feature: GYAE6OF02HDMHK.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctcaagtctggcaacacggcctccctgaccatctctgggctccaggctgaggacgaggctgattattactgcagctcatatacaaccagcagcacttctgtattcggcgaggaccagctgaccgtctaggtcagcccaggcctcgcccctggtctac

SEQ ID NO: 105082 - DNA, 510 bp, Homo sapiens
  misc_feature: GYAE6OF02IVZ4V.10.29.C07.1.454.CMB.1.raw
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (430)..(430): a, c, t, g, unknown or other
  misc_feature (430)..(430): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttatactatgtctcctggtaccaacaacaccaggcaaagcccccaaactcatgatttttgatgtcagtaatcggcctcaggggtttctaatcgcttctctggctccaagtctggcaacncggcctccngaccatctcgtggctccaggctgaggacgagctgattatcttgcagctcatatacaacancagcacttctgtattcggcggacggaccaagcgtgaccgttcaacggtcacgcccaaggcctcggcccctcggctacccg

SEQ ID NO: 105083 - DNA, 635 bp, Homo sapiens
  misc_feature: GYAE6OF02H5TDK.10.29.C07.1.454.CMB.1.raw
  modified_base (271)..(271): a, c, t, g, unknown or other
  misc_feature (271)..(271): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacnccacgacgaacaacccaaccctaacacagtattttattagtatctagtaatacggtcccgtcctacgggttacggtttaactacgtcgttcttcttcggtcgtcctaacgtacgtcgtcgaacaacgccgtccctcgtaccgaactctccttcgggtcgtccctacggacgtcgtagggacggaacgggacgtcgtagttaattttaacgttcgtacgacgtacgtcctaacgtaattaacaaaccctaacgaccgacgacaccttacttcgtagttacggtcgggacggaccgaacgacgtcgtaccggtccgtacggtcgacgacccgacggtaccgtccgtccccgtccccggtctacccg

SEQ ID NO: 105084 - DNA, 522 bp, Homo sapiens
  misc_feature: GYAE6OF02FN7ZJ.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacaccaggcaaacgcccccaaactcatgtattttgatgtcagtaatcggccctcgaggggtttctaatcgtcttctctggctccaagtctggcaacacggcctccctgaccatctcgtgggcctccaggctggaggacgaggctgattattactgcagctcatactacaaccagcagctacttctgtattcggacgaggaccagctcgaccgtcgtaggtcagcccgaggcctccgccccgtcgtcctaccg

SEQ ID NO: 105085 - DNA, 613 bp, Homo sapiens
  misc_feature: GYAE6OF02G9AQB.10.29.C07.1.454.CMB.1.raw
  modified_base (387)..(387): a, c, t, g, unknown or other
  misc_feature (387)..(387): n is a, c, g, or t
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacaacaccaggcaaacgcccccaaactcatgattttgatgtcagtaatcggcctcaggggtttctaatcgtcttctctggctcaagtctgcacacggcccctcgaccactctctcgtcgtccncggacgtgtacggacggacggcgtgtagtactttacgtacgtcgacgtctctactaataactaaccaacgacacgtactaccttacgttagttacggttacggttaccggggaacgggtaaccggaccgtacgtcggtaacccgtaccggttacggtaccgtaaccggtacccgaaccggacggtcccgtccccgtaccccgggttacccgtacccgttaccccgg

SEQ ID NO: 105086 - DNA, 816 bp, Homo sapiens
  misc_feature: GYAE6OF02IPBHO.10.29.C07.1.454.CMB.1.raw
  modified_base (250)..(250): a, c, t, g, unknown or other
  misc_feature (250)..(250): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcacatctcctgcactggaacctgctagtgacgttgggtgttaataactntgtctcctggtaccaacaacaccaggcaaacgccccaaatcaatgattttgatgtactaggtaaactccggacccttcgtacggggttttctaaacgttcggtcctttacgtcgttacggtcttacccgtaaagttccgtacggtaccgtaacgtaacccggggtccttaccccgtagtaaccccgtagtttacccgtaccgttcggggtacccttcccggtaaacggggtcccgttacggggtaaccggggttaaaccggtaccggggtaccgttaaccgggttaacgttttaacggtttaacccgttacggtaccgttaacggtacccttaccggtaaactttaaccggtaaccgttaaacccgtagggtttaaccggtaccctaaccgtttttacggtacggtttaaccgtttccggggtaaccgggtaacgggtaacccgttaacggtccggttaaccggtacccggttacccgttaacggggttaccctacgggaaccccggttaacggtcccgttaccggaccccccggtttacggttacccggtacttttaccccgggg

SEQ ID NO: 105087 - DNA, 561 bp, Homo sapiens
  misc_feature: GYAE6OF02IH9WG.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaccagcagtgacgttggtggttataactatgtctcctggtaccaacaacaccaggcaaagcccccaaactcatgatttttgatgtcagtaactcggaccctcgtaggggtttctaatcgtacttctctggtcctccaagtctggcaacaccggcctccctgaccatctctgggcctccaggctgacggcgaggctgattatactgcagctacatataccaaccagacagacctacttcttgtacttcgggacggaagggaccaagtccgtcggacccggttcccgtaaggtccacggaccccgaaggtccctcccggacccccttcgggtacctacccg

SEQ ID NO: 105088 - DNA, 522 bp, Homo sapiens
  misc_feature: GYAE6OF02IX5XW.10.29.C07.1.454.CMB.1.raw
  modified_base (251)..(251): a, c, t, g, unknown or other
  misc_feature (251)..(251): n is a, c, g, or t
  modified_base (436)..(436): a, c, t, g, unknown or other
  misc_feature (436)..(436): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacaacacccaggcaaagcccccaaactcatgatttttgatgtcagtaatcggccctcaggggtttctaatcgcttctctggctccaagtctggcaacacggcctcctgaccatctctgggctccaggctgaggacgaggctgattattactgcagctcatactacaacancagcacttctgtatcggcggaggacaagccgtgacccgtcgtaggtcacggacccaaggtccgtccgtccccgttcggtcctaccg

SEQ ID NO: 105089 - DNA, 538 bp, Homo sapiens
  misc_feature: GYAE6OF02GIPU5.10.29.C07.1.454.CMB.1.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactntgtctcctggtaccaacaacacccaggcaaacgccccaaactcatgattttgatgtcagtaatcggcctcgtagggtttctaatcgtcttctctggctcaagtctggcaacacggcctccctgaccatcctcgtcggctccgaggctggacggacgaggctgtattattactgcagctcatatacaaccgagggcacttctcgtagatacgttcggcggagggtacctggtcgtcggtaccgtcgtacgtacacgcccaacggtcctccggccccgtcgtcctaccg

SEQ ID NO: 105090 - DNA, 663 bp, Homo sapiens
  misc_feature: GYAE6OF02JV0LV.10.29.C07.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttataactntgtctctgtaccaacacaccagacaacgccccaactcttgtttgagtcagtagccgtcctgaggacgtcctgacgtcggttctctcgtcctaccgaagtccgtggacaaccgccggtcccttacccgtcggtacccgttccgtcggtcgggtccctaccgacgggtccgttagggaacggtacgttcgggacggtacgttagtaactttaaccgtacgtacggacgtaacggtccgtacttaacgttacgttaccgaaccgggtaccccgaaaggttacggggtttcggtttacggggccgggtacgggtaacgttaacgggtcgtaccggtcggtcggtcacggacccggtagccgtccggcccccgtggtacctaccgtccgttaccgttccccgcccttccgtcctaccg

SEQ ID NO: 105091 - DNA, 627 bp, Homo sapiens
  misc_feature: GYAE6OF02H9WU0.10.29.C07.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttataactatgtctctggtaccaacaacacccaggacaaacgcccccaaactcatgtacttttttgaatgtcagtaactcggccctcgtaggggtttctaaatcgtcttctctggctccaagtctgacaacacggtcctcctcgacctatcgtctcgggctccgacggtcgtggaggacggacggtctagtagtttacttaacgttcgctacgacctttcgaagtaactaactaaaccgacgtaccagtacctaactttccgttgttaacttccggggacggtacgggaacctaacggtccgttcgggaacccgttccgtaacggttacccgacgtaccccgaaacgggtcctaccggtccccccgttagggtacccttaacccg

SEQ ID NO: 105092 - DNA, 522 bp, Homo sapiens
  misc_feature: GYAE6OF02GN4Q5.10.29.C07.1.454.CMB.1.raw
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataactatgtctcctggtaccaacaacaccaggcaaacgccccaaactcatgatttttgatgtcagtaatcgcctcgtagggtttctaatcgtcttctctgctccaatctgacaacacgcctcctcgacatctcgtggctcgagctgacgngagtctgattatactgcanctnatactaacaaccacgcacactacttctgtacttacggcggaaggaccaagccgtagacctcgaaggtcctacgccaacggtccacgccccgtcgtacctaccg

SEQ ID NO: 105093 - DNA, 619 bp, Homo sapiens
  misc_feature: GYAE6OF02I2TPN.10.29.C07.1.454.CMB.1.raw
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagccctccctccgcgtccgggtctcctggacagtcagtcaccatctcctgcactggaaccagcagtgactttgttgcttaataactatcgtctcctgtaccagccaccaccaggaccaaacgcccccaaactcctttgttttgacggtcagtagccggccctnaggacgtcctgatcggttctctgcctcaagtctggcaacgcgcctccngtaccgtcncgtggcctcgagctagnggatgaggtctgattactactgacngcgntagttacttccgacggccccaagtacggggttgttacgggcgggtcgggaacgttaagggtcgtacccgggtcgttacggggtaccacggacccgtaacgggtcctcccggtccccccgttcggttaaccctacgtttcccgttacccgggttccccccgtcccctttccccgtacccttaacccg

SEQ ID NO: 105094 - DNA, 623 bp, Homo sapiens
  misc_feature: GYAE6OF02HOD2L.10.29.C07.1.454.CMB.1.raw
  modified_base (251)..(251): a, c, t, g, unknown or other
  misc_feature (251)..(251): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacaacaccaggcaaacgcccccaaatcatgtatttttgatgtcagtaatcggcctgtagggtttctaatcgtcttctctggctaccaagtctggcaacgacgtcctcctgaccatctcgtggctccgaggctgacggacgagctggtattatacgtgcagcctcataacttaacaaccagtacacgtacctaccttttactcggttaacgttccggggtaaccgggacgggaacccgtaaggtcccggttacggtaacccccggtttaccggtaaccgggttacccgaacgggtacccccgtaaagggtccccgttaacccgggttccccccttaccggggttacccttaacccccgg

SEQ ID NO: 105095 - DNA, 528 bp, Homo sapiens
  misc_feature: GYAE6OF02FFDFK.10.29.C07.1.454.CMB.1.raw
  modified_base (247)..(247): a, c, t, g, unknown or other
  misc_feature (247)..(247): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttanaactatgtctcctggttaccaacaacacccaggccaggcccccagactcatcatttctgatgtcagtgatcggcctttgggatttctaatcgcttctctcgcctcaagtctggcacgacgctccctgacatctccgggctccacgctgacggacgaggctctattattactgcagctcatataccaccgacgggcactctcgtgtactagttcgggcgggacgggaccgtcggcgttacggacccgttaccgtaccgtacgacggtacccgaacggtcccg

SEQ ID NO: 105096 - DNA, 561 bp, Homo sapiens
  misc_feature: GYAE6OF02FSJAF.10.29.C07.1.454.CMB.1.raw
  modified_base (228)..(228): a, c, t, g, unknown or other
  misc_feature (228)..(228): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacaacaccaagcaaacgccccaaactcatgtattttgatgtcagtaatcgcctgagggtttctaatcgcttctctgctcagtctgcacncgcctcctgacntctcgtcggctcgagctgaggacgngctgattattctgcagtctactactaactaacaaccgagacacgtactacttcgtacgtagttccgggacgggaacgggacaacggtccgtcggacccggttaccgtacggtaccgacggtacccggtaacggtccgtacccggtcccccgttcgggtaccttacccg

SEQ ID NO: 105097 - DNA, 605 bp, Homo sapiens
  misc_feature: GYAE6OF02HHVK6.10.29.C07.1.454.CMB.1.raw
  modified_base (366)..(366): a, c, t, g, unknown or other
  misc_feature (366)..(366): n is a, c, g, or t
  modified_base (421)..(421): a, c, t, g, unknown or other
  misc_feature (421)..(421): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctcctggtaccaacaacacccaggcaaagcccccaaactcatgattttgatgtcagtaactcggccctcgaggggtttctaatcgtcttctctggctcaagtctggcaacncggcctccctgaccgtctcgtcggctccaggctggacgatggaggctgacttacncttgcagcgctatacttacgacggtacccaagtacggggttcgtttcgggccgggtacggggtaacctaagggttccgtacccggttccgtcgggtaccgaacggaccccgtaagggtccgtacccggtcccccgttacggtacctacccgttccggttccgttccccggtcccccttaccccg

SEQ ID NO: 105098 - DNA, 660 bp, Homo sapiens
  misc_feature: GYAE6OF02GMPE1.10.29.C07.1.454.CMB.1.raw
  modified_base (243)..(243): a, c, t, g, unknown or other
  misc_feature (243)..(243): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcaggacacagggtcctgggcccagtctgccctgactcagcctgactccgtgtctgggtctcctggacagtcgatcactatctcctgcactggcaccagcagtgacagtaggtnacttataactatgtctcctggtaccagccaccacccaggacaaacgacccccaaactccgtttgttttgaggtacagtaacgccggccctcgaggacgtccctgacgttcggttctcgtcgcctaccaagtctggacaacgaccggcccttcccgtcgacccgttctccgtcgggcctccgagggtcctaggaacggatgggacggtctagtaacttacctacgtcgaccgagcgtactagttacgttaccgaccggacccaaggtacgggtttcggtttcgggaccgggtacgggtaaccgttaagggtccggacccggttccggttcggggtacctaccggaccccgtaacgggtcccgttacccggtcccccggttacggtaccctacccgtttccgttacccggttacccccc

SEQ ID NO: 105099 - DNA, 573 bp, Homo sapiens
  misc_feature: GYAE6OF02HOX4P.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacacccagcaaacgcccccaaactcatgtattttgatgtcagtaatcggcctgagggtttctaatcgtcttctcgtgtctaccaagtctggacaacaccggcctccctcgaccgtctcgtcgggctccgacggctgaggtagtgaggtctgtacttacgacttgcagcgacatctacgacggtaccccaagtgggtgtttcgggcggacgggtactaacgggtcgtaccgtcgtcggtcgacggacccaaggtccgtccggcccccgtcggtccacgttcccgtcgttccccgtccccttacccg

SEQ ID NO: 105100 - DNA, 532 bp, Homo sapiens
  misc_feature: GYAE6OF02GF00D.10.29.C07.1.454.CMB.1.raw
  modified_base (429)..(429): a, c, t, g, unknown or other
  misc_feature (429)..(429): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgattttgatgtcagtaatcggccctcgtaggggtttctaatcgcttctctcggctccaagtctggcaacacggcctccctgaccatctctgggctccgaggctgaggacgaggctgattattactgcagctnatatacaaccagcagctacttctcgtagttcgggcggagggaccaggcgtcggaccgtccgtagtccacgacccaacggtcctccggcccctcggtctacccg

SEQ ID NO: 105101 - DNA, 649 bp, Homo sapiens
  misc_feature: GYAE6OF02HSXKQ.10.29.C07.1.454.CMB.1.raw
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgtacgttggtgttaataactatgtctcctggtaccaacaaccacccaagacaaacgaccccccaaactcatacgtatttttgattgctagtaactcggccctcgaggggtttactaatcgtcttctctggctacctaagtctggacaacaccggcctccctacgacctactctcgtcgggcctccgtacggcgtcggaacggacgaggccttagactttacttaacgtcggtnaccccgtntacctagtaactacaaacctagcgacgacctacttcgttagttacgttccgggacgggaacgggtacctacggtaccgttacggaaccccggttacgtaaccgggttaccaaccggtacccggtaaacggtccccggttacccggtcccccccgtttacggggtcccttaaccccgg

SEQ ID NO: 105102 - DNA, 688 bp, Homo sapiens
  misc_feature: GYAE6OF02JFAQJ.10.29.C07.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttataactntgtctcctggtaccaacaacacccaggcaaacgcccccaaactcatgatttttgatgtcagtaatcggccctcgaggggtttctaagtcgtcttctctcggtctcctaagtcgtggcaacacggcctccctgaccatctcgtcgggtcctccgacggtcgtaggacgggacggacggtcgtagtaactttagttaccttcgaccgtacgtccgtactaataacttaacccgtaaaccgacgtacccgaacgtaccgttaaccgtttccgttacggtttacgttaccgggggtaccggggaacccggggtaaccgaaacggtcccggttaacggggtaaccccggtttaccggttaaccgggttacccggaaccggtaccccggaaacgggtacccggttcccggcccccccggtttaccgggtaccctttaaccccgg

SEQ ID NO: 105103 - DNA, 595 bp, Homo sapiens
  misc_feature: GYAE6OF02F7IK8.10.29.C07.1.454.CMB.1.raw
  modified_base (226)..(226): a, c, t, g, unknown or other
  misc_feature (226)..(226): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttatactatgtctcctggtaccaacaacaccaggcaaacgcccccaactcatgatttttgatgtcagtaactcggccctcgtaggggtttctaatcgcttctctgctccagtctggcacacggcctcctgaccatctctcgggctccgaggctagaggacgaggccgtgtaattacgttacgtgacctacggcctactataacctaaccaaccagtaccacgtacctacctttctacgttacgttcgggaccggaacgggtaccaacggccgttaccggaccgttaccggtaacggttaccgaccggtacccgtaacggtcctacccggtcccccgttcgggtaccttacccgg

SEQ ID NO: 105104 - DNA, 778 bp, Homo sapiens
  misc_feature: GYAE6OF02G7ACW.10.29.C07.1.454.CMB.1.raw
  modified_base (243)..(243): a, c, t, g, unknown or other
  misc_feature (243)..(243): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtnacttaataactatgtctcctgtaaccaacaacaccaggccacggccccagactacatctatttctgtatgtcagtgactccggtcccgttttgggactttactaacttcgtcttcctctcgtcctaccgaagtcgtacggaccaaccgtaccggtccttaccccgtcgaaccctactcccggttcccgggccttcccgaaccgtcgtacgggtaaacgggtacccggaacggggtaccctttacgtaaacgttttaaccgtttaaccgtacggtaccgtaacggtacccttaacctaacgttaaaccgttaaaccccgaaccccgggtaacgggggtacccttaacccgttaccggtttaccggttaacgttaccggtttaacggtttcccggggggtaaaccggggttaacccgggggtaaacccggttccggggttaaccccgtttacccgggtaaacccccggttttaccccggttaacccgggttaccccggaaacccgggttaccccccgggtaaacggttccccccggg

SEQ ID NO: 105105 - DNA, 687 bp, Homo sapiens
  misc_feature: GYAE6OF02G8FZU.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacaccagacaaacgcccccaaactcatgtattttgatgtcagtaatccggcctcgtaggggtttactaacgtcgtcttctctggtcctccaagtcctaggaccaacgaccggtccctcccgtacgacccacttacctcgtcgggctccgaggccgtacggacgggtacggagggtccttagtaaacgtttaatttaaagtcgaccgtacggtctacgtaattaactaaccaaaccgtaacgaccgtaacgaccgttacttttaccgtacggtttacggttaccggggtaccgggtaaccggggtaaccgtaacggtacccggttcggtaacccggttacccggttaacgggttacccgaccggtacccggtaacggtcccgtacccggaccccccggttccgggtacccttaccccgg

SEQ ID NO: 105106 - DNA, 716 bp, Homo sapiens
  misc_feature: GYAE6OF02IODTP.10.29.C07.1.454.CMB.1.raw
  modified_base (251)..(251): a, c, t, g, unknown or other
  misc_feature (251)..(251): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacaacaccaggacaaacgccccaaactcaatgtattttgatgtcagtaatcggccctgtagggtttctaatcgtcttcttctcggccttaccgaagtcttacggccaacgtaccgggtcccttaccctacgaccctacttccgttcgtcgggtccttacccgaggtccgttagggaacgggtacggtaaccgggtcgttacggttaacttttacgttaacgttcggtactaacggtccttaactaacttaacttaacccgaaaccgtaacgtaccgtacgtaacccttaccgtttacgtttaccgttaacggttccgggggtaacccgggaacggggtaacccgtaacggtaccgtccgggttaaccccgttacggttaacggttccgtaaaccggacccggtacggtacccggtcccggttaccccccgttcgggttacccttaacccgg

SEQ ID NO: 105107 - DNA, 535 bp, Homo sapiens
  misc_feature: GYAE6OF02G7O24.10.29.C07.1.454.CMB.1.raw
  modified_base (252)..(252): a, c, t, g, unknown or other
  misc_feature (252)..(252): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacaacaccagcaaagccccaaactcatgattttgatgtcagtatcggccctcaggggtttcaatcgcttctctgctccaagtctggcaacacggcctccctcgaccactctcgtcgggctccgaggctggaggacgaggctgattatactgcagctcatacacaaccagcagacctacttctgttacttcggacgggagggaccaagccgtacgtacccggtactacggtcacgacccacgggcctccgtcccccgtcggtctacccg

SEQ ID NO: 105108 - DNA, 596 bp, Homo sapiens
  misc_feature: GYAE6OF02HYXC2.10.29.C07.1.454.CMB.1.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (464)..(464): a, c, t, g, unknown or other
  misc_feature (464)..(464): n is a, c, g, or t
tcagcatagtagtgcacgaccggtgctcgatttagagtgctacgaagggaaaggggggggtcgtcgaggaggcagcgctctcaggacgtcaccaccatggcctgggctctgctcctcctcaccctcctcactcagggcacagggtcctgggcccaggtctgccctgactcagccctccctccgccgtccgggtctccgtggaccagtccagtcaccatcctcctgcactcggaaccagcaagtcgacttttgtgctttataactntgtctctgtacngcaccaccagacaacgacccaaactccttgttttcgacgtacagtaagcgcctcacggtctccgtcgtacgtcgttctctcncctacagtctgacaacncggcctccctgtaccgtctcgtcgggtctccgaggctacggagtacgtaggacgtcgtacgtacgttaactcgacgcacgcgctaatntccgacgtaccccgaagtcgggttgttcgggacggttcgacggtacggtcgtcccgtacgtcggaccacggtacccgaggtccgtccggtccccgttgcctaccgtccgttccgttcccacccgtctacccg

SEQ ID NO: 105109 - DNA, 547 bp, Homo sapiens
  misc_feature: GYAE6OF02FITWM.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccagcagtgacgttggtggttataactatgtctcctggtaccaacaacacccaggcaaacgcccccaaactcatgtatttttgatgtcagtaatcggccctgaggggtttcaatcgcttctctgctcaagtctgcaacacggcctccctcgaccatctctgggcctccgaggctgacgggacgaggctagtattattactgactacgctcatactaacaaccagcagcacttcgtcgttagttcgggcggagggaccaagccgtcgaccgtcccgtaggtccacggacccgaaggtccgtccggccccccttggtcctaccg

SEQ ID NO: 105110 - DNA, 555 bp, Homo sapiens
  misc_feature: GYAE6OF02IA3JF.10.29.C07.1.454.CMB.1.raw
  modified_base (252)..(252): a, c, t, g, unknown or other
  misc_feature (252)..(252): n is a, c, g, or t
  modified_base (379)..(379): a, c, t, g, unknown or other
  misc_feature (379)..(379): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacaacacccaggcaaaagccccccaaatcatgatttttgattgtcagtaatccggccctcgaggggtttctaatcgcttctcgtggctcaagtctggcaacacggcctcccngaccatctctcgggctccgaggctgaggacgaggctaggtattattacgtgacagctcatactacaaccagcagctactttctgttacgttcgggacgggagaccgagtcgtcggtaccgtacgtacgtccgacgacccgtaacggccttcccggcccccgttccggtcctacccg

SEQ ID NO: 105111 - DNA, 660 bp, Homo sapiens
  misc_feature: GYAE6OF02HDAZ4.10.29.C07.1.454.CMB.1.raw
  modified_base (212)..(212): a, c, t, g, unknown or other
  misc_feature (212)..(212): n is a, c, g, or t
tcagcatagtagtgcacgaccggtgctcgatttagagtgctacgaagggaaaggggggggtctcaggaggcagcgctctcgggacgtctccaccatggcctgggctctgctattcttcaccctcctcactcagggcacagggtcctgggcccagtctgccctgactcagcctgcctccgtgtctgggtctcctggacagtcgatcaccatcncctgcactggaaccagcagtgacgttggtagttataactatgtctctgtaccaacaacaccagcaaacgccccaatcatgtattttgatgtcagtactccggcctacacggactcctgtactcggttctcgtcgcctcgaacgtctgacaaccgaccggtcccttcccgacgtacccgttctcgtcgggcctccgaacggtcgtaggaggtagtggacggtctagtacttaacttacgtcgtacacggctactaagttacgttaccgaacccggtaccccgtaaagggtaggggtttacggtttcggggaccgggtaccggtaacgttaacgggtccggtacccggttcggtacgggtccgaacgggtacccgaaggtccccgtaccggtccccccggttacggtaccctaccggtttccccggttacccggtcccccgttacccccg

SEQ ID NO: 105112 - DNA, 663 bp, Homo sapiens
  misc_feature: GYAE6OF02FF3UY.10.29.C07.1.454.CMB.1.raw
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (462)..(462): a, c, t, g, unknown or other
  misc_feature (462)..(462): n is a, c, g, or t
  modified_base (498)..(499): a, c, t, g, unknown or other
  misc_feature (498)..(499): n is a, c, g, or t
  modified_base (507)..(507): a, c, t, g, unknown or other
  misc_feature (507)..(507): n is a, c, g, or t
  modified_base (551)..(551): a, c, t, g, unknown or other
  misc_feature (551)..(551): n is a, c, g, or t
  modified_base (576)..(576): a, c, t, g, unknown or other
  misc_feature (576)..(576): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacgagggtcctgggcccagtctcgccctgacctcacgcctcgcctccgtgtcctgggtcctaccgtggacnggtccgatccaccatcctcctcgcacgtggaaccngcagtgtacgttggtcgtataactntctcnctcgtaccacacaccgagacaaccgaccccaatcattagttacttttgacttcgtaactaacgtacgtccggtccctaggttaacgggtttacctacgttccgttcttccgtacgtcggtccgtaacgtacgttcgtacgacccaaccgtccgtacccgtacgtaccaccgtactcgtcgcgtcctacgngtcgacggacgtacggacgtcttagtaactagtccnncccgtaancctaacaactaccgtaacacgagacctaattccgttagttccgngtttaaccggccggacgtaaccggntaccggcgttaaccgggacctaccggtcgtaacccgaaccgttacccgggccttaccccggtccccgtaccgtactccgttaccccg

SEQ ID NO: 105113 - DNA, 627 bp, Homo sapiens
  misc_feature: GYAE6OF02HD1SP.10.29.C07.1.454.CMB.1.raw
  modified_base (272)..(272): a, c, t, g, unknown or other
  misc_feature (272)..(272): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccagcagtgacgttggtggttataacgtatgtctcctggtaccaanaacaccaggacaaacgccccaaactcatcgtattttgatgtcagtaatcggcctcgtagggtttctaatcgtacttcgtctcggtcctacctaagtcgtaggcctaaccgaccggtccctaccctcgacctactccgtcgtgggtacctccgtaggtcctaggaggtacgaggctagtattattacgtgctagtctactactactacaaccgagaccacgacgtaaccttgttacgttacgttcgggaccggtaagggtaccacggtacgtaccgggtaacccgttaccgtacggtacccgtacggacccggtaacggtcccgttaccgccccccggtttcggacccttaccccg

SEQ ID NO: 105114 - DNA, 667 bp, Homo sapiens
  misc_feature: GYAE6OF02I7DKT.10.29.C07.1.454.CMB.1.raw
  modified_base (469)..(469): a, c, t, g, unknown or other
  misc_feature (469)..(469): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctctggtaccaacaacaccagacaaacgcccccaaactcatgtattttgattcgtactagtaagtccggtccctcgtacggggtttctaattcgtcttctctcggtcctccgaagtctaggaccaacgaccggtccctcccgtcgacctatccgtcgtcgggtcctcccgagggtccgtagacgggtacggaggtccgtagtacttaatttaccgngtacgacgtccttactaataactaacccgaaaccgtacgacacggtacctaccgtttcgtaggttaccgttccggggaaccgggtaacgggaccctaacgggttccgtaccggtaaccccggttccgtaacggttccccaaccggtacccgtaaccggtccgttaccccgacccccggttccggtacccttaccccgg

SEQ ID NO: 105115 - DNA, 715 bp, Homo sapiens
  misc_feature: GYAE6OF02HMQTH.10.29.C07.1.454.CMB.1.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactggaaccagcagtgacgttggtagttataactatgtctctggtaccaacaacacccagacaaacgcccccaaactcatgtatttttgattgtacagtaacgtccggcccttcgtaggggttttactaagttccggtacttcctcgtcggtccctacgaacgttcctagggacctaaacgtacccggtcccttaccctacgaacccgtattaccgtccgttacgggcccttaccgagggtccgtaggaacgggacggtaggtccgtaggtaattttacttacgtgtactacgtctacgaataccgttaaccaaccgacgtaccgtaacgtaccttaccctttagttaccggtttacggtttaccgggaccgggtaacgggtaacccgaaggtacccggtaccggtaccccgttaccggttaacggtcccgtaaccggtacccggaaccgggttcccggtaccccggtcccccggttaccgggttacccttaaccccggg

SEQ ID NO: 105116 - DNA, 665 bp, Homo sapiens
  misc_feature: GYAE6OF02FS3RT.10.29.C07.1.454.CMB.1.raw
  modified_base (227)..(227): a, c, t, g, unknown or other
  misc_feature (227)..(227): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtaggttataactatgtctcctggtaccaacaacacccaggcaaacgcccccaaactcatgtattttgatgtcagtaactcggccctcgacggggttttactaagtccgctttctcgtggtcctccaagtctggcaacgacggcctccctcgaccatcctcgtggcctccgagtctaggagggacgacggtctaggtacttagttactggctacgtctactaattaactaacctaaaccgacgacgaacgtaccttaccgtttacgttacgtttaacggttccggggaacggggtaaccgggaacccgtaacggtaccgttaccgggtaacccgggttacccgttaacggggtacccaaccgggtacccccggtaagggtccccgttaccccggtccccccggttaccgggttcccttaaccccgg

SEQ ID NO: 105117 - DNA, 678 bp, Homo sapiens
  misc_feature: GYAE6OF02G1KSW.10.29.C07.1.454.CMB.1.raw
tcagcatagtagtgcacgaccggtgctcgatttagagtgctacgaagggaaaggggggggtctcaggaggcagcgctctcgggacgtcaccaccatggcctgggctctgctcctcctcaccctcctcactcagggcacagggtcctgggcccagtctgccctgactcacgcctccctccgcgtccggtctccgtggacagtcagtcaccatctcctgcactggaaccagcagtgtacttttgttgcttaataactattgtctcctggtaccagcaccaccaggaccaaacgcccccaattcctttgtttgagtcaagtaacgccggcctcgaggtactcctgacttcggttcctcgtcgccctacgaagtctcggaccaaccgtaccgccctccgtcgacccttcgtccgtcgggtcctccggaggtccgttggaggtgtacggacggtctagtattacgtacgtcgacgacggtctactattacgtaccgaaccggtaccccgtaaaggtccgggtttcggtttcggggaccgggtacgggtaacgttaacgggtccgtacccggttcgtacgggtaccgacgtacccggaacggtcccgtacccggtcccccggtacggtacctacccgttccgttaccccggttcccccgtcccctttacccgtaccctaacccg

SEQ ID NO: 105118 - DNA, 526 bp, Homo sapiens
  misc_feature: GYAE6OF02FI607.10.29.C07.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctgtaccaacacaccaggcaaacgcccccaactcatgtattttgatgtcagtaactcggccctgagggtttcaatcgtcttctcnggctcagtctgcaacncgcctcctnaccntcnctcggctcagcngagacgngctgattatcngcagctcatacacaccagcacgctacttctagtacgttcgggacgaacggtaccaagtccgtacggacccgtaccgtacggtccacggacccgaggtccctccggccccgtcggtcctaccg

SEQ ID NO: 105119 - DNA, 727 bp, Homo sapiens
  misc_feature: GYAE6OF02I5G5G.10.29.C07.1.454.CMB.1.raw
  modified_base (308)..(308): a, c, t, g, unknown or other
  misc_feature (308)..(308): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggcagtcgatcaccatctcctgcactggaaccagcagtgacgttggtgttatactatgtctcctggtaccaacaacacccaggccaacgacccccaaactcatagtatttttanagttgtcagtaactccggccctcggtacggggtttctaacgtcgtctttcctctcggtctacagtcgtggacaacgacgtcctcctcgacctactctcggtcggcctaccggacggtcgtaggcgggacggtacgccgttagtacgtttaacgttacgtacggtactacggtaccctacgttaacttaactaaaccccgtaaccgtaccggacaccgttaccgttacccgtttaccgtttacgggttacccggtttaccgggggtacccgggtaacggggtaaccccgtaaggtccccgggttaacggtacccccggtttacccgggttaacgggttacccggtaacccgggaccccggttaacgggtccccccggttacccggtccccccggttacccggttacccgtttacccccgg

SEQ ID NO: 105120 - DNA, 670 bp, Homo sapiens
  misc_feature: GYAE6OF02IQ0PI.10.29.C07.1.454.CMB.1.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
tcagcatagtagtgcacgaccggtgctcgatttagagtgctacgaaggggaaagggggggtctcaggaggccagcgctcgtcgggacgtctccaccatggcctgggctctgctattcctcaccctctcactcagggcacgagggtcctgggcccaggttcctgccctgacttcagcctgcctccgtgtctgggtctctggacagtcaggtcactgtctcctgcgactggaaccngcagtgtactttgtncttanaactatcgtctctgtacctagcaccaccaggacaaacgccccaaactccttgttttcgacgtcgagtaacgccggacctcgaggacgtccctgtacttcggtctacgtcgacccttacaacgtcgtaggtaccaacgtaccggtccttaaccgtcggacccgttctacgttcgggaccttccgaggtaccgttaggacggtacttagggacgtaccgtacggtaaacttaccgttacgagttccgaacgtcgtaccaagttttaacgccgaaccggaccctaacggagggttcgttcgggaccggtaccggagttaacggtcgtaccgtacgttagggtaccgaagtaccccggaaggtccctaaccggtccccgtcggtactaccggttcgttcccggtccctaacccggttccc

SEQ ID NO: 105121 - DNA, 607 bp, Homo sapiens
  misc_feature: GYAE6OF02GCQX3.10.29.C07.1.454.CMB.1.raw
  modified_base (307)..(307): a, c, t, g, unknown or other
  misc_feature (307)..(307): n is a, c, g, or t
  modified_base (410)..(410): a, c, t, g, unknown or other
  misc_feature (410)..(410): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccagcagtgacgttggtggttaataactatgtctcctagtaccaacaacaccagacaaacgacccaactcatgtattttanatgtacagtacgtccgacctcgtagggttactagtacgtcttctctcgtctacgagtctggacaacgaccgtcctacctcgacctatcctcgtcgcgtaccgnggtcgtacggacggtacgacggctagtactagttaactcgactacgtcctacgtaactactaaccgaaccaagtacgacgacctacttacgtcgttacgtacgggacggacggacgacgtaccgtacggtaaccgtacgtacggtacaccggacccggacggtacccgtacccggccccgttacggtccctacccgg

SEQ ID NO: 105122 - DNA, 697 bp, Homo sapiens
  misc_feature: GYAE6OF02FI1X0.10.29.C07.1.454.CMB.1.raw
  modified_base (226)..(226): a, c, t, g, unknown or other
  misc_feature (226)..(226): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccngcagtgacggttggtaggttataactatgtctccgtgtaccaacaaccaccaggacaaacgacccccaactcatgtattttgatgtacagtaactccggtccctcgtagggttttactaacgtccgtctttcgtcgtcggtcctaccgtaagtcgtacggaccaaaccgtaccggtcccctcccgtacgaacctacgttccgtccgttcgggacccttccgaggtccgtagggaacgggacggtcggtacgtagttaacttacgttacgtcgtcctaacggtcctaacgtacttaactaaccaaaccgacgtccgaagtacctactttcgtacggttacggttaccggggacgggtacgggacctaacggtaccgttaccgggtacccggttacccgtaacgggtacccgtaaccggtaccccggtacggtcccgttccccggtacccccggttccggtacccgttacccg

SEQ ID NO: 105123 - DNA, 689 bp, Homo sapiens
  misc_feature: GYAE6OF02GIL68.10.29.C07.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctctgcactggaaccngcagtgacgttggtagttanaactatgtctcctgtaccagccaccaccngacaacgccccaatccttgtttgngtcagagcgccncgaggactccagtacttcggtctcgtcgcctacagttcaggacaaccgacgtcccttaccgtacgtacccgtcgttcgccgggtcctaccgacggtctagggacggtacgtagggacgtcgttagtaacttacccgtagtacgacacggtaccgtacttacttacggtacgaacccggaccccgtaagggttacggggttttcggtttcggggaccggggtacgggtaacgtacggggtaccggtaccggttcccggttggggacccgtaccggtaacccggtaacgggcccttacccccggtaccccggtacgggttaccctccggtttaccccggttcccggttaccccccggttaccctacccccgtttacccg

SEQ ID NO: 105124 - DNA, 642 bp, Homo sapiens
  misc_feature: GYAE6OF02JC24P.10.29.C07.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgccacgtggaaccngcagtgacgttggtgttataactntgtctctgtaccaacaaccaccaggacaaacgaccccaaactcactgtattttcgattgtcagtatccggtcctcgtagggtttctaatcgtcttctctgcctacgtagtcgtggacacgacgcctcctcgacctactcgtcgtcgggtcctaccgacggtcgtacgggacggacggtacggtcgtaggtacgttacgttaacgttcgaacgtacgccttaactactaacgttaaccaaccgagtaccgaacgccttaccgtttaccgttggttaccggtttacggggaaccggtaacggacgaacggtaccgtacggtacccgttacggtaacgtccgaaccggtacccgtacgggtacccttcccgcccccggtacgtcctacccgg

SEQ ID NO: 105125 - DNA, 613 bp, Homo sapiens
  misc_feature: GYAE6OF02JFD66.10.29.C07.1.454.CMB.1.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (575)..(575): a, c, t, g, unknown or other
  misc_feature (575)..(575): n is a, c, g, or t
tcagcatagtagtgcacgaccggtgctcgatttagagtgctacgaagggaaaggggggggtctcaggaggcagcgctctcgggacgtctccgaccatggcctgggctctgctattcctcaccctctcactcaggcacagggtcctggcccagtctgccctgactcagcctgcctccgtgtcctgggtctcctggacagtcgatcaccatcctcctagcactggaaccagcagtgacgttggtagttatactatgtctcctggtaccaacacaccaggacaaagccccaaatcctttgttttgagtcagtaagcggcctnaggacgtcctgatcggttctcgtcgcctacaagtctggaccaacncggtcctccngaccgttcacgtggcctcgaggtctaggacgatcggacgtctcgatttaccagcgtacacgcgaccttatacgttccaacggacccctaaagacggggtttgttacggggccgtaaccgggacgtttaaacgggtcgtaacccgtaccgtggggttaccaacggtcccctaaagggtcctaaccggtcccccgtggtaccncgtttccgtccgttaccccacccctttccacccttaac

SEQ ID NO: 105126 - DNA, 733 bp, Homo sapiens
  misc_feature: GYAE6OF02I1X1B.10.29.C07.1.454.CMB.1.raw
  modified_base (270)..(270): a, c, t, g, unknown or other
  misc_feature (270)..(270): n is a, c, g, or t
tcagcatagtagtgcacgaccggtgctcgatttagagtgctacgaaggggaaagggggggggtctcaggaggcagcgctctcgggacgtctccaccatggcctgggctctgctattcctcaccctcctcactcagggcacgagggtcctgggcccagtctcgccctgactcacgcctcgcctccgtgtcgtcgggtctccgtggacagtcgatccaccactcctcctgccacgtacgaccagcgagtgtacggttggtagttaataactntcgtctcgtacggtaaccaacaacaccgaggaaccaaaccgacccctaaactctagttacgttattttagacgttacggacgtaacgttaacgtcccggtaccgttacgggttacggggttttacctaacgttccgttacctttccgttacgttacggtacctaaccgttaacggtccgtacggaaccgaacccggtaccgtccctacccgtacgtacctacgtccgttcggtcgggccctaccggagggtacacgggacgggacgtggtaccgttagtaacgtttacgtacgtcgacctacgtacctactaacgtaaccaaccgtacagtaccgacgtacttacgttacgtaacgttcggtaccggaacgggacggtaaccctaggccgtaacggttacccagggtacaccgacccgtaccgtacgggtcccctacccggtacccggttcgtaccgtacccg

SEQ ID NO: 105127 - DNA, 210 bp, Homo sapiens
  misc_feature: GYAE6OF02I6EKN.10.29.C07.1.454.CMB.1.raw
  modified_base (198)..(210): a, c, t, g, unknown or other
  misc_feature (198)..(210): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcgagggcacgagggtcctgggcccagtctgccctgactcgagcctgcctccgtgtctcgggtctcgnnnnnnnnnnnnn

SEQ ID NO: 105128 - DNA, 662 bp, Homo sapiens
  misc_feature: GYAE6OF02G9884.10.29.C07.1.454.CMB.1.raw
  modified_base (266)..(266): a, c, t, g, unknown or other
  misc_feature (266)..(266): n is a, c, g, or t
  modified_base (391)..(391): a, c, t, g, unknown or other
  misc_feature (391)..(391): n is a, c, g, or t
  modified_base (493)..(493): a, c, t, g, unknown or other
  misc_feature (493)..(493): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacaggtcgatcaccgtatcctcctgcacgtcggaaccagtcagtgtacggttggtagttactaacgtntgttctcgtacgtaccaacaaccaccaggcaaaccgaccccaactcatgtacttttgactgtactaaggtacgccggtcctgacggtctacctgacgttcgtctccgtccggacccctaaggtcnccggaacaacgccggtcctaccggcgtacccgtttcgccggttcggccttccgagggtcaggtacgtagtcggacggtactagttaactacgttgcgacgcnccgacgtatccgtacgaccggtacccgaaggttcgggttggttcggacgggtaccggtacgtaacgggtcgtaccggttcggcggtccgaaccgtccggtaacggtccctcccggtcccgtaccggtccttacccgttccgtttacccggtacccctccccttaccccg

SEQ ID NO: 105129 - DNA, 750 bp, Homo sapiens
  misc_feature: GYAE6OF02I4M6I.10.29.C07.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (586)..(586): a, c, t, g, unknown or other
  misc_feature (586)..(586): n is a, c, g, or t
tcagcatagtagtgcacgaccggtgctcgatttagagtgctacgaaggggaaaggggggggtctcaggaggcagcgctctcgggacgtctccaccatggcctgggctctgcttattcctcaccctcctcactcagggcacgagggtcctcgggcccagttctcgccctgactcagcctgcctcgtgtctgggtctcgngacngtcgatcaccntctcctgacacgtcggaaccngcgagttcgtacggttttgggtagttaataaccgttagttcgttccttaccgtacggtaacccaacaaccgaccgaacggaacccaaaccgaccccctaaactctattacgtttagtttttcgattacggtactaacggtacgtacccggtcccgttacgggttacgggttttacctacgttccgttccttcgtccgtcggtccttaccgtagttccgtacggacccaaccggtcccggtaccctccgtaccaaccgttctaccgttcggcggttccaccggtgtcgtagggacggacgtacgggcttaagtatttacttacgcgctacgtcttactactaacaccgtaacncgaccgtaatcccttacgtttcgttaacggttacggtacccggggacggtaacccggtacgtaccggttaccgtaaccggttacccggttacggttaaccggacccgtaaccggacccgtaccgggtacccctaccccgggtacccgtccgttacccgttaccg

SEQ ID NO: 105130 - DNA, 942 bp, Homo sapiens
  misc_feature: GYAE6OF02FID2Y.10.29.C07.1.454.CMB.1.raw
  modified_base (231)..(231): a, c, t, g, unknown or other
  misc_feature (231)..(231): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgacctcagcctgccctccgtgtctgggtctccgtggacagtcgatcaccatcctcctgcactggaaccngcagtgacgttggtaggttacaactatgtctcctggtaccaacaacacccaggacaaacgccccccaaactccatgtattttgattgtacacgtaagtccggaccctcgtacggggtttactaacgtcgtcttcctcgtcggtcctacccgtaagttccgtacggtaccaaaccgtacccggtcccctccccgttacggtaaccctaccgttccttcgtacggggtacccttcccggtaaccgggtccgttaacgggaaccggggtaaccgggtaaccggggttaccgttaaccgggttaaacgtttaaaccgttttaaccggtttaggaccccgttaacgggtaccccttaacgttaaccgttaaaaccgtttaaaccccggaaaaccccgtaaccggtaccgtaaaccggttaccccgtttaaaccgtttttacccggtttaacgttttaaaccgggggtttccccgggggtaacccgggggttaaaaccggggggttaaccccgtaaaaccggggttaccccggttttaaacccgggttaaccccccggggtttaaacccccggttttaaacccggggggttacccccgaaaaccccggggttaaccccccgggtaaaaacccgggggtttccccccggtttaaccccccggggtaccccccccccgggttttaacccgggttaccccccggtttttaaccccccggg

SEQ ID NO: 105131 - DNA, 997 bp, Homo sapiens
  misc_feature: GYAE6OF02HWCLI.10.29.C07.1.454.CMB.1.raw
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgacctcagcctgccctccgccggtcccgggtctccgtaggacacgtacgacgtaccaccctactcctcccttcgacctaaccgttacgggaaacccgagaccgtaaggttacgtaacgttttggttttacgactttttaaacgtaaccttaattcggttcctccgttaccgggtaacccacggacccaaccccgaacccaacgggaacccaaaacccgaccccccttaaaaccgttcccttttaggtttttaccggaacggtttaccgtaaggtaaccgggtcccggtacccctaccgtaacgggtcccgttaccccgttagtacgtttcccggttaccttccgtccgtaccccgttacccgtaaacggttccgtacggaacccgtaaaacccgtaccccggtacccccgtaccccgttaccggtaccccggtttcccgtcccggtttacccgggggtacccgttaccccgggtaggttacccggttggggaaaacgggttacggttacgggaggttcccgttaaacgggttaccttttaaacccggtaacggtttacccgggaacgtacggtacccgtacgttaaaccgtaaccgtttaacccgacccggtaaaccccccggtaaagggttacggggtttaccggggttttaaccggggggaacccgggttacccggggtaaaaccggggttaaggtcccggggtttaccccgtaacccggggttggtaaacccggtccggaccgggaacccggtccgttacccccggttccccggtacgttaccctcccggtacccgtttccccggttcccccgtcccttacccggtaaccc

SEQ ID NO: 105132 - DNA, 806 bp, Homo sapiens
  misc_feature: GYAE6OF02I2QUS.10.29.C07.1.454.CMB.1.raw
  modified_base (108)..(108): a, c, t, g, unknown or other
  misc_feature (108)..(108): n is a, c, g, or t
  modified_base (439)..(439): a, c, t, g, unknown or other
  misc_feature (439)..(439): n is a, c, g, or t
tcagcatagtagtgcacgaccggtgctcgatttagagtgctacgaagggaaaggggggggtctcaggaggcagcgctctcgggacgtctccaccatggcctgggctcngctattcctcaccctcctcactcgaggcacgagggtcctgggcccagtctcgccctgactcacgctgcctcgtgtctcgggtctcgtggactacggtcgactcgacctatcctccgtcgaccacgtcggaaacctgcctaggttcgtacggtttggtacggttaactacttagttcgtaccttccgtacggtaacccaaaccgaaccaacccgtagaacccgaaccgaacccccctaacgtacctagtaggtttacttttacgacgttgtaccctaggtaaccgttcccgggtcctttacgggtacggttttacacggttccttaccgttntaccgtcgtcctacgttaacggtcctcggaacccgtaacgtacccgtccctaccgttccaaaccttcgtaccgttacgtcgggttacccaccggtcgggtacgttagggaccggttaacggtacggacttaacgttaaccttacgttaaccggtcgttccggtacgttaacctaccgtaaccgttaataaacccccgtactaggaaccctaacgttaccgtttaccgttacgttaccgggtttacggtaccgggtaacggggtcaaacccggttacggtaccgtaacccttacccggggttaacgtaccgtaccggaccgtcggtacccggtacccgcccggtttaccccgagttaccccttcccgg

SEQ ID NO: 105133 - DNA, 776 bp, Homo sapiens
  misc_feature: GYAE6OF02HT4DM.10.29.C07.1.454.CMB.1.raw
  modified_base (181)..(181): a, c, t, g, unknown or other
  misc_feature (181)..(181): n is a, c, g, or t
tcagcatagtagtgcacgaccggtgctcgatttagagtgctacgaaggggaaagggggggggtctcaggaggcagcgctctcgggacgtctccaccatggcctgggctctgctattcctcaccctcctcactcagggcacgagggtcctgggcccagtctgccctgactcacgccctcccnccgcgtccgggtctccgtggacagtcagtaccaccatcctacctgcacgtacggaaccagtcagttgtacttttgtcgtacttaatacgttattcgtcctccgtcggtaccacgaccaacccaccgacggaccaaaaccgtcccccctaaacgtttccgttttagttttacgacggtacgtaacggtaaccggcccggtaccctacggacggtaccgtcccgttaggtaccgtttcgggtttacctcgtccgtacctacccgttacgttacgtcggtaaccgaaccggtacccgtcccgttacccgtaccgtacccgtttccgttccggttacggacccgttaccggacggtcgtagggtaaccggtaggtcggtaacggttcgttaacgttaacgttaaccgttcgtacgaccgtaacgtcgttaaccgtagttaaccgtccggaacccgtaaccgttagggtacgggtttgggtaccgggacggttacgggaacgttgggaccgtccggtcgtaggaccgtaccggacggaccgtcggtcccgtaccgtcgtacctccgttccgtacccgttccccgtcttacccagttaccg

SEQ ID NO: 105134 - DNA, 836 bp, Homo sapiens
  misc_feature: GYAE6OF02JHKRH.10.29.C07.1.454.CMB.1.raw
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcacctcctcactcagggcacgtagggtcctgggcccagttctcgccctgactcagcctcgcctcgtgtcgtgggtctccgtggacngtcgatccacatctccngccacgtggacccagctaacggtgtacgttttgggtagttactaactgttctcttaccgtggtaaccagccaaacccgaccgaaggacccaaaaccgacccccttaaacgtttccgtttaggttttcgacgttacgtaagtaacgtcccgtctacggtacggacgttccctagtacgttccggttcgttcctacgacccttacgtaacggttccgtcggaacctaaaccggtcccggtcccttacccgtacgggttacccgttccgttccggttacggaccctacccggtaagtcccgttaaaggtacgggacgttacggggccgttaaacgttacggttaaaccgtttacccgttaaccgtagggtaacctcggtaaccgttaacttaacgtttacccgtaccggtacccggtaaacccgtaaacggggtttcgggtttaccggggttaggggtacccgggttaccgggttaaccgtttaaacgggtcccggttccgggttaaggttcccgggacgtaaacccgtccggtaaccgggttcccgcccggttcccgttaccgccgtttaaccggttcccttaccccggttaaccccttccttacccggttaacccc

SEQ ID NO: 105135 - DNA, 811 bp, Homo sapiens
  misc_feature: GYAE6OF02HF2IH.10.29.C07.1.454.CMB.1.raw
  modified_base (262)..(262): a, c, t, g, unknown or other
  misc_feature (262)..(262): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcgagggcacgacgggtcctcgggcccagtctcggcccttgactcacgcctgtccctccgtgtcgtgggttcctccgtggactagtacgtactaccacctacttcctacctcgccgtacgtaccggaaaccncgcgtacggtcggtacggttggttaggttacttaacgttagtcgttccgttccgtacggtaacccaaaccaaccgtaacccgtaacggaaaccgtaaaccccgaacccccctaaaacttacccgtaattacggttagtttttagtacttacggttacctaaggttaaccgtccggtcccgtacgttacggggtttactaacgttccgtaccttccgtcgtacggtacctaccgtacgttacgtaccgacctaaccgtccggtccctacccgtacgtaccgtcgttacctcggtaccggtccgtcgtacggtacgtacgggacgtggtagtgttactaacgtttctacgtcgtacaccgtctagttactcggtacgttaggtacgttccgttacgttcccggtttacgtttacgttacggggttaccggtacggtacggacgtccgggtacgttccggtaaaccgttccggtaacgtaaccggaacccgtaaccggtaccggttaccccgtacccgttaccccggttccgtccgttacccgttcccccgg

SEQ ID NO: 105136 - DNA, 634 bp, Homo sapiens
  misc_feature: GYAE6OF02IDZCT.10.29.C07.1.454.CMB.1.raw
  modified_base (307)..(307): a, c, t, g, unknown or other
  misc_feature (307)..(307): n is a, c, g, or t
  modified_base (398)..(398): a, c, t, g, unknown or other
  misc_feature (398)..(398): n is a, c, g, or t
tcagcatagtagtgcacgaccggtgctcgatttagagtgctacgaagggaaagggggggggtctcaggaggcagcgctctcgggacgtctccaccatggcctgggctctgctattcctcaccctcctcactcagggcacagggtcctgggcccagtctgccctgactcagcctgccctccgtgtctgggtcctcctggacagtcgatcaccatcctcctgccactggaaccagcagtgacgttggtagttaatactatgtctctgtacaacacaccagacaacgccccaactcatcgtatttttagnttgtactaagtacgtccggtccctacgtacggggtttactagtcgtcttctcgtcggtcctccaagtctacggacaaccgccgtccctccncgacctacgtccgtcgtcgggcctcgacggctacggacggacggtacgggtctaggtactttaagttaccgtagctacgtcctacgtaactaactaccctaaccgagtaccacgtaccttaccgttcgttagttacgttcggggacggtaccggaccgaacgccgtaccggtacccgtcggtacggtacgacccggaccgtacggtcccttcccggcccgttacccggtctacccg

SEQ ID NO: 105137 - DNA, 721 bp, Homo sapiens
  misc_feature: GYAE6OF02HCPMI.10.29.C07.1.454.CMB.1.raw
  modified_base (593)..(593): a, c, t, g, unknown or other
  misc_feature (593)..(593): n is a, c, g, or t
  modified_base (663)..(663): a, c, t, g, unknown or other
  misc_feature (663)..(663): n is a, c, g, or t
tcagcatagtagtgcacgaccggtgctcgatttagagtgctacgaagggaaaggggggggtcgtcgacggaggcagcgctctcgggacgtctccaccatcggcctgggctctcgctattcctacaccctcctacactcgagggacacgaggtccgtcggccagtctcgcctgactcagcctcgccgtcgtgtcggttcggtacctcgtaggacaggtaccgagtccaaccgtattccgtacctggactaaccgtacggtaaccaggtacgtacggttaggttccgggtttaagggttacgtttaaactaaacgttgttaccggtaccgttaccggttaccgtaaacccgtaaaccgtaaccccaaccggaacggaaacctaaacccggaaccccctaaacgtactacgtttcgtttaaagtttcgtacttacggtactaacggtttaacgtcccggtccgtttagggtaccggttttactaacgtccttacttcgtcgtacgtccgtaacctagtcgtacgacgaaccgtccgtacctcgacactcgcgttcgcgtctcgacgtgacgacgtacgcgtagtactattacgtancgctatacgtctaatacctaacgaacgtacacgtcacttactcgtacgtaacggccggtaagaccgacgngtaccgcgttacctgacgacgtaccgacgtcgacccgtcgtaccgttacggtcttccg

SEQ ID NO: 105138 - DNA, 776 bp, Homo sapiens
  misc_feature: GYAE6OF02JSX5Y.10.29.C07.1.454.CMB.1.raw
  modified_base (573)..(573): a, c, t, g, unknown or other
  misc_feature (573)..(573): n is a, c, g, or t
tcagcatagtagtgcacgaccggtgctcgatttagagtgctacgaagggaaaggggggggtctcaggaggcagcgctctcgggacgtctccaccatgcctgggctctgctattcctcaccctcctcactcgagggcacgcgggtcctcgggccagtctcgccctgactcacgcctgcctcgtcgtcgtcggtcctcgtaggacgtgtacgactcaacctctcctccgtcgactacgtacggactacgcgtagttcgtacgttttgtcgtactttaacgtaactcgttcggttccttccggttacgtaccacgtaccgaaccctaccgaacggaacccaaaccgtaccccttaacgtttcgtttaggtttcggtaacgtcgtaaggtacgccggtacctcggtacgtaccgtccgtagtaccgttcggtactccgtctaccgtacggtacgtccgtcggaaccgtaacgtcccggtcctaccgtaccggttacctcgtccggtcgtaccgtacgacggtcgtaacggtacggtagacgcgtttacgacggttacctacgtcgtacgtcgaacgngtctacgtacccgtaagacccggtacgtacgggttcgggttaccgggtcgggtacgggtacggtaaacgttcggggtaaccttaccggggttccgaccgggtagaaccccgggacggttaccgggtaaccgtccccggttacccggtaccggtttaccctaaccggttcccgtttaccccgttacccgtaccccgtttacccg

SEQ ID NO: 105139 - DNA, 797 bp, Homo sapiens
  misc_feature: GYAE6OF02H0DN5.10.29.C07.1.454.CMB.1.raw
  modified_base (234)..(234): a, c, t, g, unknown or other
  misc_feature (234)..(234): n is a, c, g, or t
tcagcatagtagtgcacgaccggtgctcgatttagagtgctacgaagggaaaggggggggtctcgaggaggcagcgctctcgggacgtctccaccatggcctgggctctgctattcctcaccctctcactcagggcacgagggtcctgggcccagtctgcctgactcagcctgcctccgtgtctgggtctcgtggacagtcgatccactatcctcctgaccacgtcggaaaccngcgtaacggtgtacggtttggttagttaactaacgtgttgtcctaccgtacggtaaccaactaaccaccgaagtacccaaacgtacccccaaactacgactagttattttaggactcgtacgacgtactacccgggtaccttaccggtacggggttttactagtccggtctttacgtcgttacggcccttaccgtaaggttcgtacggaccgtaacccgaccggtcccttaccgtacgacccttacgtccgttaccggtacgggtcctccgacggtcgtacgggtaacgaccgggtggtaacgtgttaacgtttacgtttaacgcgtacgtacgtaaccgttaccaagtaaccgtaccaaacgtcggaaccgtactaaacccgtttacgttaaccttcggtttaaacggtcgggtaaccgggtaaaccgggtacctaaacgggttccctaaccggggttccgtaaccggtttaaccgggacccggtaaaccgttacccccggtaaagggttcccccgtaaaccccccggttccccggttaaccggtccccgttttaaccccgg

SEQ ID NO: 105140 - DNA, 565 bp, Homo sapiens
  misc_feature: GYAE6OF01BYJKS.24.64.F09.1.454.CMB.1.raw
  modified_base (194)..(194): a, c, t, g, unknown or other
  misc_feature (194)..(194): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtggganacagagtcaccatcacttgccgggcaagtcagggcattagaagtgatttaggctggtatcagcagaaaccagggaacgcccctaaggtcctgatctatgctgcatcccgtttanaaagtgggtccatcaagttcagcgnagtggatctggcacagtatttcactctcaccatcagcagcctgccagcctgaagtatcttaggtaactttattactgtactacaagtacttaacaactttacccggtaggtaaccgtttcgggacccgtaaacggggaaccgtaaaggggtacggtaaaaacgtccgggtaaaacggtaaccgttagggtacgggtaccttacggaccctaacccgtagttccgtttaccgg

SEQ ID NO: 105141 - DNA, 569 bp, Homo sapiens
  misc_feature: GYAE6OF01DHXKK.24.64.F09.1.454.CMB.1.raw
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctcctgtctgcatctgtgggagacagagtcaccatcacttgccgggcaagtcgagggcattagaagtgatttaggctggtatcagcaagaaaccgagggaaacgccccgtaaggtcctgatctatgctgctacttcccgtttaacaaggttcgggtacccagtacgtaaggttcaggcggacgaaggtggatcgtggacacagtacttcactctacaccatcacgcacgcctgcacgcctagaagtcttcgttaggtaactttattacgtcgtactaacgtaagtacttaacgtaacttaacccggtggtaaccggttcggaccgaaagggtaacccgaagggtacgaaagtacggaaacggaacgtggtacggtcgtacgaccacctagtcgttacg

SEQ ID NO: 105142 - DNA, 530 bp, Homo sapiens
  misc_feature: GYAE6OF01ACS67.24.64.F09.1.454.CMB.1.raw
  modified_base (309)..(309): a, c, t, g, unknown or other
  misc_feature (309)..(309): n is a, c, g, or t
  modified_base (524)..(524): a, c, t, g, unknown or other
  misc_feature (524)..(524): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaccatcacttgccgggcaagtcagggcattagaagtgatttaggctggtatcagcagaaaccaggaaacgccccgtaaggtcctgatctatgctgcatcccgtttanaagtggggtcccatcaaggttcagcggcagtggatctggcacgagtatttcactctcaccatcagcagcctgcagcctagaagtatcgtttaggaactttattactgttacctaactaagtactttacaacgtttacccgtaggaccgttcggaccgaaaggggacctaagggtgaaagtcggaaacgtacgtaggtcggtcttacgacaacccntcttcg

SEQ ID NO: 105143 - DNA, 546 bp, Homo sapiens
  misc_feature: GYAE6OF01CJFPB.24.64.F09.1.454.CMB.1.raw
  modified_base (267)..(267): a, c, t, g, unknown or other
  misc_feature (267)..(267): n is a, c, g, or t
tcagactactatgtcacgaccggtgctcgatttagcgcgtatacaaggggggcaggagtcagacccactcaggacacagcatggacatgagggtcccccgctcagctcctgggcctcctgctgctctggctctcaggtgccatatgtgacatccagatgacccagtctccatccctccctgtctgcatctgtgggagacagagtcaccatctctgccaggcagtcaggctattaactactttagtaaattggtatcatacaaaacgngacgaacggtaccctaactcgtggtacaacgatcgcataccaagtcggtcgaccgacgggcccctagtcgtaaggttcgaggcggcagtagatcgtagggtactacgtttccttcaccttcacctatcgacgcgctgcagctggagtagtgtgactactattacttatcgtacaaactattatagacgtatacgttagtacttacgtttcgggacgtaggggaacgtagggtaggacgtcgtaacgaaacgtacgtcggtacgacttcgcctaacgtcg

SEQ ID NO: 105144 - DNA, 682 bp, Homo sapiens
  misc_feature: GYAE6OF01DCW77.24.64.F09.1.454.CMB.1.raw
  modified_base (204)..(204): a, c, t, g, unknown or other
  misc_feature (204)..(204): n is a, c, g, or t
tcagactactatgtcacgaccggtgctcgatttagcgcgtatacaagggggcaggagtcagacccactcaggacacagcatggacatggacgggtcccccgctcagcctccgtggggctcctgctgctctggctcccaggtgccagatgtgccatccagatcgacccagtcctccatccctccctgtcctgcatcgtggtgganacagagtccacatcactggccggcaagtcgagggctaagttagagtagtagttaggctggtatcgagacgaacgaaaccgaagggaaacgtacccgtaaggtcctagactctagtcgctgactacgttacccgttaacgaaacggtcgggtaccagttaccgtaaggttcgaacggcggacgtaaggtcgtagtcgtacgactacgattacttccaactctaccactactaccgagctacgcctgactaacgcgtagtaagtacgttaccgttaagtaactttagttacgttacgtaacttaacgtaacgttaacgtttaaccgtaacgttttaacccgggtagggttaaccccgggttaacggtaaacccggaaacggggtaaacccgttaaacggggaacggttaaaaccgttacgggaaacgttaacggtacggtacggtacgtaaccggacctaacccgtagttccgtttaccg

SEQ ID NO: 105145 - DNA, 613 bp, Homo sapiens
  misc_feature: GYAE6OF01DK2NK.24.64.F09.1.454.CMB.1.raw
  modified_base (195)..(195): a, c, t, g, unknown or other
  misc_feature (195)..(195): n is a, c, g, or t
  modified_base (323)..(323): a, c, t, g, unknown or other
  misc_feature (323)..(323): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctggtggganacagacgtcaccatcacgttgccgggcaagtcagggctattagagtgatttaggctggtatcagacagaaaccgagggaaaccgccccgtaaggtcctagactctatgctgactacgtcccgtttaanaaggtcgggtaccagtacgaaggttcacggcgacaggtggatcgtgacacagtatttcacttcacacatcagcacgtcctgacacgtccgtagaaacgtctttacgtaggttaactttacttacgttcgttaactaacgaacgttaactttaaacgaacgttttacccggtagggtacccgttaccgggtaccggaaaacgggtaaccgtaaaggggttaacgtaaaagtaccggtaaaacggtacgttagggtacggtccttacggaccctaaccgtattcggttaccg

SEQ ID NO: 105146 - DNA, 595 bp, Homo sapiens
  misc_feature: GYAE6OF01AJKR1.24.64.F09.1.454.CMB.1.raw
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaccatcacttgccgggcaagtcagggcattagaagtgatttaggctggtatcagcagaaaccgagggaacgcccctaaggtcctgatctatgctgctacttcccgtttaacgaaggtcgggtaccctatacgtaaggttcagcggcaggtggatcgtggacacagtatttcacttctcacctatcacgcagcctgcacgcctagaagtacttcgtttacggtaactttatttactgttacctaactaagttaacttaactaacgtttacccggtacggtaaccgtttaccgggaccgtaaacggggtaacccgaaagggttacggtaaagttaccgggaaaccgtacggtacggtacgggtaccgttacgacccgtaaccgtgttcgttaccg

SEQ ID NO: 105147 - DNA, 675 bp, Homo sapiens
  misc_feature: GYAE6OF01C49Y5.24.64.F09.1.454.CMB.1.raw
  modified_base (199)..(199): a, c, t, g, unknown or other
  misc_feature (199)..(199): n is a, c, g, or t
tcagactactatgtcacgaccggtgctcgatttagcgcgtatacaagggggcaggagtcagacccactcaggacacagcatggacatgagggtccccgctcagctccgtggggctcctgctgctctggctcccaggtgccagatgtgccatccagatcgacccagtcctccatccctcctgtctgcatcgtggtggganacagacgtccacctatcacgttcggccgggacaaggtcgagggctaagttaggaagtgtagtttaggctaggtatcgagacaacggaaacgagggaacctcccgtaagtcctgactctatcggtctgactacgttaccgttaagaacggtcggtaccagtacgtaaggttcgacggcggtacgaggttcgacttcgtcggacaacgttagtactttccgacttcgtaccaactacgtcgacgcgtacgtccgtaggacctacggtacctaggtaacgtacttacggtttaacgtaactttacgttacgtacgtaacctaacgtaaagttaccttaaccgttaacggtttaccccggaggttaacccggttaccggaacccggtaaacgggtaccgtaaaggggttaaccgaaagttacccggaaacgtacgttgggacccgttacaccggaacctccgttaagttcgttaacccgg

SEQ ID NO: 105148 - DNA, 781 bp, Homo sapiens
  misc_feature: GYAE6OF01C7E88.24.64.F09.1.454.CMB.1.raw
  modified_base (200)..(200): a, c, t, g, unknown or other
  misc_feature (200)..(200): n is a, c, g, or t
tcagactactatgtcacgaccggtgctcgatttagcgcgtatacaagggggcaggagtcagacccactcaggacacagcatggacatgagggtcccccgctcagctcctggggctcctgctgctctggctccccgaggtgccagatgtgccatccagatcgacccagtcctccatccctccctgtctgcatctggtgganacagacgtccaaccatcctacgttcggcccgggtactaaaggtccgaaggggtctaagttaaggaaggttagtacgtttagggccttaggtatacgagaccaacggaaaccgaggggtaaaccgtacccccgtaaaggttcccgtagtacttaccgtaagtcgtctcgaccttaccgttaccccggtttaacgtaaacgggttccgggtaccctaacgtacgtaaacgggttccaagggtccggaccgtaggtaggtacgttcggtacggtaccacgttaaggttactttaccgtaccttaccctaccaacccgtactaccgacggtaccctaacgtccgttaacgcccgaaccgttaccgtaaggtaacgttaccttaacggtttaacggtttaaactttacgtttaaccgttcggttaacttaaacgtaaacgttacctttaaaccgttaaccggtttacccgggttacggtaaccggttacccggtaaaccggaaacgggtaccgtaaacggggtacgaaacgttaacggaaaccgttaacgttggtccggtactaccgactaacctcgttcttaccg

SEQ ID NO: 105149 - DNA, 624 bp, Homo sapiens
  misc_feature: GYAE6OF01B68ZS.24.64.F09.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtggganacagagtccacatcacttgccgggnaagtcagggcattagaagtgtatttaggctggtatcagcaagaaaccgagggaaacgcccgtaaggtcctgatctatgctgctacttaccgtttaacgaacggtcgggtacccagtacgtaacggttcaggcggcgaggtggactcgtggaccagtacgtactttaccgaccttcctaccacctactacgacgaccgtacgtccgtcgaccacggtcctaaggaacgtacgtttacgtttaacgggttaactttacgttaaccttcgttaacctaacgtaagttaacttaacgtaaccgtttaccggtacggtaccggttaccggaccgtaaacgggaccgtaaagggtacggtaaagtaccggaaagtaccgtaggtacggtctacgtaccacgtgtcgttacg

SEQ ID NO: 105150 - DNA, 634 bp, Homo sapiens
  misc_feature: GYAE6OF01DLFNB.24.64.F09.1.454.CMB.1.raw
  modified_base (202)..(202): a, c, t, g, unknown or other
  misc_feature (202)..(202): n is a, c, g, or t
  modified_base (429)..(429): a, c, t, g, unknown or other
  misc_feature (429)..(429): n is a, c, g, or t
  modified_base (626)..(626): a, c, t, g, unknown or other
  misc_feature (626)..(626): n is a, c, g, or t
tcagactactatgtcacgaccggtgctcgatttagcgcgtatacaagggggcaggagtcagacccactcaggacacagcatggacatggagggtccccgctcagctccgtggggctcctgctgctctggctcccaggtgccagatgtcgccatccagatcgacccagtctccactccctccctgtctgcatcgtggtggganacgagacgtccaccatctacgttcggccggacaacggtcgaggctagttagaagtgtagttaggctaggtatcgagacgaacggaaaccgagggaaccgtacccgtaggtcctagtactctagtcgtctcgtactacgttacccgttaagaacggtcggtacctagtacgtacgtcaggcgtcgagtgactcgtcgactactagtacttctaccgtctacactctancgactacgcgtacgactacgaccgttaagtaacgttactttacgaacttaaacgtttcgtaaccgtcgtaaacccgttagtacgttacgtatacgttccgtaccgtttaccctccccgttaccgggtcgacccggtaacggggtccctaaggacgttaacggaacttaacgttacggtacgtaacggttgcggtccncggtaccc

SEQ ID NO: 105151 - DNA, 715 bp, Homo sapiens
  misc_feature: GYAE6OF01CSRKH.24.64.F09.1.454.CMB.1.raw
  modified_base (209)..(209): a, c, t, g, unknown or other
  misc_feature (209)..(209): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtcgccagatgtcgcccatcccaagatcgacccctagtcctccactccctccctgtctgctatcgtggtcggganacgagacgtccaaccatccacgttcggaccgggacaacgtcgagggtctaagttaacggaagtgtaacgtttaggcgttaggtactcacgacaacggaaaccgaacgggaaaccgaccccgtaacggtcctagacttactatacgtctgactaccgttacccgttaacgaacggttcgggtaccctagttacgtaacggttcgacggccggtcgaggtacggagtcgtggtacacgtagttacttacgtctacctaccgtactataccgacgtaccgacgttccgacggcctacggacccgttaaggtaaacgtacgtttaccgtttaaggttaaccttttactacgtttaacgtaaccttaaacgtaaacgttaacttaaccgttaaaccgtttaccgggtacggttacccggtaccgggtaaccggtaaacgggtaccgtaagggtaacgtaacgtacggtaaacgacgttaggtacgtactacgacctactgttcgttacccg

SEQ ID NO: 105152 - DNA, 680 bp, Homo sapiens
  misc_feature: GYAE6OF01BVQS5.24.64.F09.1.454.CMB.1.raw
  modified_base (189)..(189): a, c, t, g, unknown or other
  misc_feature (189)..(189): n is a, c, g, or t
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
  modified_base (318)..(318): a, c, t, g, unknown or other
  misc_feature (318)..(318): n is a, c, g, or t
tcagactactatgtcacgaccggtgctcgatttagcgcgtatacaagggggcaggagtcagacccactcaggacacagcatggacatgagggtcccccgctcagctccgtggggcctcctgctgctctggctcccaggtgccagatgtgccatccagatcgacccagtcctccactccctccctgtctncatcgtggtggagacagacgtccaccatccacgttggaccggnaagtcgaggctattagagtgatttaggntggtatcgtagcacgaaaccgagggaaacgccccgtaaggtccctagtactctagtcncgtgctacgttacccgtttaacaacggtcgggtacccagtcgaaggttcgagcggacacggtggtactcgtacggcaacgtagtacgtttcaaccttccgtactaaccctataccaagacaacgtccgtacgacgacgtaccctaggaacgtacttacggttaacgttaacctttagtttactattaaccgttaagtaacgttactttaaaccggtaacctttaacccggtacgggttaacccggttaccgggtaaccgtaaaccggggtaaacccggtaagggtaaccggaaacgttacccggtaaacggaaacccggtttggaccgggtacctacggacccaccgttagtccgtttaccg

SEQ ID NO: 105153 - DNA, 722 bp, Homo sapiens
  misc_feature: GYAE6OF01D1K6A.24.64.F09.1.454.CMB.1.raw
  modified_base (141)..(141): a, c, t, g, unknown or other
  misc_feature (141)..(141): n is a, c, g, or t
  modified_base (210)..(210): a, c, t, g, unknown or other
  misc_feature (210)..(210): n is a, c, g, or t
  modified_base (353)..(353): a, c, t, g, unknown or other
  misc_feature (353)..(353): n is a, c, g, or t
tcagactactatgtcacgaccggtgctcgatttagcgcgtatacaagggggcaggagtcagacccactcaggacacagcatggacatgagggtccccgctcagctccgtggggctcctgctgctcgtggcctcccaggtcnccagatgtcgccatccagatcgacccagtcctccactcccttcctgtctcgctagttcgtggtaggganacgagacgtaccaccgtatccgtacgttcggaccggacaaggtcgaggtactaagttaagaagtgtagttaggcgtggtactacgagacgaaacgaaccgaacgggaacctacccggtaaggtcctagtactactagtcgtcncgtacctaccgttaaccgtttaacgaacgggttaccgggtacctacgtaacgtacggttacgacggacgtacgtaggtcggtactcggtacgactacgtacgttactttccgacttcctaccgtaaccctagtccgaacgtccgtacgtccgtacgacgtaccgtacgtaaatacgttacgtttagttaacggtttaactttacgttcgtacgttaaactaacgtaacctttaacttaacccggttaaccgttaccgggttacggaccccgggttaacgaaccgggaaacggtaaccgtaaagggtaaccggtaacctaaccggaacgttaggtcgacgtacgaccctacctacgttcttcggttaccg

SEQ ID NO: 105154 - DNA, 807 bp, Homo sapiens
  misc_feature: GYAE6OF01EZ6J1.24.64.F09.1.454.CMB.1.raw
  modified_base (205)..(205): a, c, t, g, unknown or other
  misc_feature (205)..(205): n is a, c, g, or t
  modified_base (798)..(798): a, c, t, g, unknown or other
  misc_feature (798)..(798): n is a, c, g, or t
tcagactactatgtcacgaccggtgctcgatttagcgcgtatacaaggggggcaggagtcagacccactcaggacacagcatggacatgacgggtccccgctcagctcctggggcctcctgctgctctggctcccaggtgccagatgtcgccatccagatcgacccagtctccctactcctcctgtctgcattcgtggtaggganacgagtacgtaccaacctatccgtaaccgttcgggaccgggacaacggttaccggaggggtactaagttaaggaagttaggtaacgtttagggaccttagggtactccgaacgacgaaaacggaaaccggtaaacggggtaaaccggtaccccgttaaacgggtccctaaggtacttaccgttaacgtcgtcgtactaccggttaacctttaccccggtttaaagtaaaccggggttcggggttaccctaaggttaaccgtaacgggtttacgacgggtaccggaacgttagggtacggactacggttacgggaccttaacgtaacgtttacgtttacctaaccgttacctaccgtaaaccgttagtaaccgacaccgtaacgtccgttacgtaccgacgtaccgtaagtaacgtaacgtttcgttaaacgttaactttacgttaacgtccgttaaactaacgtaacgttaacttaacccggttaacgttaacccggtacggttaaccggtacgggtaaccgtaaacggaacgtaaaggtaacggtaaacgtacgaaaccgttacgaggtaccggtctacggtactaacggtntcgttaccg

SEQ ID NO: 105155 - DNA, 735 bp, Homo sapiens
  misc_feature: GYAE6OF01EUI0Q.24.64.F09.1.454.CMB.1.raw
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtcgccatccagatcgaccccagtcctccactccctcctgtctgctatcgtggtaggggagacaggacgtaccacctatccacgttcggccgggacaagtcgagggctagttagaagtgtattaggctggtatcagacaagaaccgaagggaaccgtccccgtaaggtccgtgatctatcgctagtctacttacccgtttaaggaacggtcgggtaccctagtaccgtaacggttacgacggcggtacgtaggttaggtacgttcgtacgggaccgtaacgtaacggttacttttacccgtaaccctttacccgtacctaaacccgacttacccggaaacggtcccaacggtcccgtacgtacccgtaacgtacccgtaaggtaaaccgttcgtttaacggttaacgtttaaaccgtttactttaaccgtacgttaacttaaacgtaaagttaaccttaaacgttaacccggttaacccggttaggttaacccggttacccgggaaaccgtaaacggggtaacctaaggggtaacggtaaacgtaccggaaacgtaacgtggtacggtactacgacaaccgtgttgttaccg

SEQ ID NO: 105156 - DNA, 687 bp, Homo sapiens
  misc_feature: GYAE6OF01B0O24.24.64.F09.1.454.CMB.1.raw
  modified_base (98)..(98): a, c, t, g, unknown or other
  misc_feature (98)..(98): n is a, c, g, or t
  modified_base (194)..(194): a, c, t, g, unknown or other
  misc_feature (194)..(194): n is a, c, g, or t
tcagactactatgtcacgaccggtgctcgatttagcgcgtatacaagggggcagggagtcagacccactcaggacacagcatggacatgagggtcccnctcagctcctgggctcctgctgctctggctcccaggtgccagatgtgccatccagatcgacccagtctccatcctcctgtctgcatcgtgtggganacagagtcaccatctacgttcgccggacaagtcagggtcattagaagtgatttaggcgtggtatcagacacgaaaccgaggtaaacgaccctaaattcctagactctagtaacggtcgtacttatttaacgaaggttcgggttaccttacgaaggttacacggtcggacgtaggttcggacgtacggttacgggaacgtaaggtaactttaccgtaaccttacgttacccgtaaacgtaaacgtaccgtaacggtacccgaacggtaccccgttagggacccgtacggtaacccgttaggtaaccgtttaggttacgtttttacgaaccttttaaacgtttaactttaaccgtacgtaaccctaaagtaaggtttaacgtaggtaacgtcgtacctttacgtacccgtaccgttccggaccggtacggggacacggtactcggtaactacgttacgacgtacgttagtacggtactcgactacgtcgttaccg

SEQ ID NO: 105157 - DNA, 762 bp, Homo sapiens
  misc_feature: GYAE6OF01DWZYG.24.64.F09.1.454.CMB.1.raw
  modified_base (100)..(100): a, c, t, g, unknown or other
  misc_feature (100)..(100): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
tcagactactatgtcacgaccggtgctcgatttagcgcgtatacaagggggcaggagtcagacccactcaggacacagcatggacatgagggtcccccgntcagctcctgggctcctgctgctctggctcccgaggtcgccagatgtgccatccagatcgaccctagtctccactccctcctgtctgctatcgtggtgggacacagacgtccactatctacgtcggccgganaggtcgaggtcaagttaggagtgtagtttcggngttggtatcaagacaacggaaaaccggaggtaacccgtcccgttaacggtcctagtacttcgtacgtgctcgtactaccgtttaaccgttaacgaacgggttccggtaccctagttcgtaacgtcgaggtccggtagtaggtggtactcgacggactacgtaagtttaccttcctaccttacgaccctactataccgaccgtcgaccgtcctacggaccgtacgtacccgttaaggtaaccgttacgtttaccgtttaacggtttaaacccttttacgtttaaccggtagtttaacccgttaaaaccgttaacgttaacccgttttaaaccgtaacccggtttacccggggtacgggttaacccgggtaacccgggtaaacccgggtaaagggtaaacccgggtaagggggtaaaaacgtaacccggttaacgggtaaaacggtcggttgggtaccggttaaccggtaccctaaccgtaacctccgttgttaccccg

SEQ ID NO: 105158 - DNA, 776 bp, Homo sapiens
  misc_feature: GYAE6OF01D9VQ5.24.64.F09.1.454.CMB.1.raw
  modified_base (135)..(135): a, c, t, g, unknown or other
  misc_feature (135)..(135): n is a, c, g, or t
  modified_base (202)..(202): a, c, t, g, unknown or other
  misc_feature (202)..(202): n is a, c, g, or t
tcagactactatgtcacgaccggtgctcgatttagcgcgtatacaaggggcaggagtcagacccactcaggacacagcatggacatgagggtccccgctcagctccgtgggctcctgctgctctggctccaggtnccagatgtgccatccagatcgaccctagtcctccacttccctccctgtcctgcatcgtggtaggganacgaggtacgtaccaaccattccgacgtttcgggacccgggtacaaaggttccgaaggggtacctaagtttaacggaacggttgttaacgttttacgggccgtttaggtaactcgaagaccgtaaacggaaaccgaacggggtaaaccgtcccccgttaaagggtcccgtaggtacttcgtacgtcgtacctacggtaccttaccgttaccccgttttaaacggaaacgggttcccgggtaccctaagttacccgtaaagggtttccgaacgggtccggtacgtacgggttcggaacttcggtacggactaacgtaaggttacctttaccgacttcccgtaacctaaccgtagtaccgacgtacctaccgtccgtagacccgtacgtaccgttaagacgttacgtttccggttaagttaacctttacgttacgttacgtactaaacgtaacgttaacttaacgttaaccgttaccggtaggttacccgttaccgggaacgtaacgggaacgtaacgggtacgtaaaccgtcggaaaccgtaggtcgtacgtctacgactacctagtcgttaccg

SEQ ID NO: 105159 - DNA, 473 bp, Homo sapiens
  misc_feature: GYAE6OF02IGUQ2.24.64.F09.1.454.CMB.1.raw
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
tcagactactatgtcacgaccggtgctcgatttagcgcgtatacaagggggcaggagtcagacccactcaggacacagcatggacatgagggtccccgctcagctcctgggctcctgctgctctggctcccaggtgccagatgtgccatccagatgacccagtctccatcctccctgtctgcatctgtgggagacagagtcaccatcacttgccgggcaagtcagggcattagaagtgatttaggctggtatcagcagaaaccagggaaagcccctaaggtcctgatctatgctgcatcccgtttacaagtgggtcccatcaaggttcagcggcagtggatctggcacagatttcactctcacatcagcagcctgcagcctgaagntcttgaacttattatcgtatacaagnttaacattacccgngacgttcgcaaggcaaggtgaatcgaagactgtggctgacacatctg

SEQ ID NO: 105160 - DNA, 504 bp, Homo sapiens
  misc_feature: GYAE6OF02FPU7D.24.64.F09.1.454.CMB.1.raw
  modified_base (196)..(196): a, c, t, g, unknown or other
  misc_feature (196)..(196): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccacagggccacctggcgtcgcggacaggttcagtggcagtggctttgggacagacttcactctcatcatcgacagactggacgcccgaagattttgctagtgtattactgtcagtctgtttgtccctcttcctcctactgttactacttttcggcctagggttcccaggtcgtggtagatcgaagcgtaacgtgtggctcg

SEQ ID NO: 105161 - DNA, 566 bp, Homo sapiens
  misc_feature: GYAE6OF02GYZ0U.24.64.F09.1.454.CMB.1.raw
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaacatcacttgttgggcaagtgagaccattagcagctctttgagttggcatcaattcaaaccagggaaagcccctaactcctgatctatactgcgtccaatttacacagtgggtcccatccaggttcagtggcaatggatctgggacagagttcactctcacccatcagcagtctgccaacctgaaacgtactttcggctaaactttactatttacgtacaaactagtagtttaaccacggtttcccccgtactacccgttaccgggcgggacgggtacccgtaagggtcggaacggtaacttccgaaaccgtaccggtaaccgttggttacgggacccttaggacccaacccgtagttacccg

SEQ ID NO: 105162 - DNA, 584 bp, Homo sapiens
  misc_feature: GYAE6OF02HT3M8.24.64.F09.1.454.CMB.1.raw
  modified_base (194)..(194): a, c, t, g, unknown or other
  misc_feature (194)..(194): n is a, c, g, or t
  modified_base (394)..(394): a, c, t, g, unknown or other
  misc_feature (394)..(394): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtggganacagagtcaccatcacttgccgggcaagtcagggcattagaagtgatttaggctggtatcagcagaaaccagggaaagcccctaaggtcctgatctatgctgcatcccgtttacaaagtgggtccatcaaggttcaggcggcagtggatctggcacagatttcgactctcacctatcagcagtcctgcagcctagaagtntcgttagtaacttattacgtctactacaagtacttaactaacgtttacccggtaggtaaccggtttccggaccgtaaacggggtaccgtaaacggggttaacggtaaaacggtaccggaaaccggtaaaccggttcggtacggggtaccttacgggtacccgtaaacccgttacgttaccgtttacccgg

SEQ ID NO: 105163 - DNA, 487 bp, Homo sapiens
  misc_feature: GYAE6OF02FJIUN.24.64.F09.1.454.CMB.1.raw
tcagactactatgtcacgaccggtgctcgatttagcgcgtatacaagggggcaggagtcagacccactcaggacacagcatggacatgagggtccccgctcagctcctgggctcctgctgctctggctcccaggtgccagatgtgccatccagatgacccagtctccatcctccctgtctgcatctgtgggagacagagtcaccatcacttgccgggcaagtcagggcattagaagtgatttaggctggtatcagcagaaccaggaaagcccctaaggtcctgatctatgctgcatcccgttacaaagtggggtcccatcaaggttcagcggcagtggatctggcacagatttcactctcaccatcagcagcctgcagcctgagatcttggaactttattactgtactacaagtattaacaattacccgtggtacgttcggaccagggaccaaggtggaaatcgaacgaactgtgctgcacatctcg

SEQ ID NO: 105164 - DNA, 619 bp, Homo sapiens
  misc_feature: GYAE6OF02GGSBS.24.64.F09.1.454.CMB.1.raw
  modified_base (253)..(253): a, c, t, g, unknown or other
  misc_feature (253)..(253): n is a, c, g, or t
  modified_base (363)..(363): a, c, t, g, unknown or other
  misc_feature (363)..(363): n is a, c, g, or t
tcagactactatgtcacgaccggtgctcgatttagcgcgtatacaaggggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaccatcacttgccgggcaagtcaggcattagaagtgatttaggctggtancagcaagaaaccaggggaaacgccccgtaaggtcctgatctatgctgcactcccgttaacaaggtcgggtaccagtcaaggttcagcggacaggtggatcgtgctacagntttacgactctcaccatcagcacgcctcgaccagccgtagaacgtactacgttaggtaactttacgttacgtagttactaacgtaaagtactttaacctaaaccgttacccggttaggtacccggtttaccgggaccggtaacgggtacccggtaaacggggtacgggtaaaaccgttaccggtaaaccggtaaacccgttcgggtaccggtaccgttaaccggaccgtaaccccttaggttacccgtttacccgg

SEQ ID NO: 105165 - DNA, 532 bp, Homo sapiens
  misc_feature: GYAE6OF02FWKGX.24.64.F09.1.454.CMB.1.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaccatcacttgccgggcaagtcagggcattagaagtgatttaggctggtatcagcagaaccagggaancccctaaggtcctgatctatgctgcatcccgttanaagtcgggtccatcaaggttcagcggcaggtggatcgtggcacagtatttcactctacaccatcagcagcctgcagcctagaagtnttccgttaggtaacctttattactgttactaacaagtattactaacttacccgtaggtaccgttcggacctaaggggacctaagggtcggaaattccggaaacgtaacgtggtacggtctacgacctaccgtatcgttacg

SEQ ID NO: 105166 - DNA, 608 bp, Homo sapiens
  misc_feature: GYAE6OF02GL5RA.24.64.F09.1.454.CMB.1.raw
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctggtgggagacagagtcaccatcacttgccgggcaagtcagggcattagaagtgatttaggctggtatcagcagaaaccgagggaaacgcccctaaggtcctgatctatgctgcacttccgtttaacgaaggttcggggtcccagtacgaaggttcaggcggacaggtggatcgtggcacgagtactttacgacttctaccaccatacagccagccctgcctagccgttagaacgtattacctttagggtaaactttattaaccgttgttacctaacgtaagttacttaacgtaaacgtttaccccggtaggttaaccggttaccgggaccgtaacggggtaacccgtaaagggtacggtaaaacgttacggaaaccggtaacgttaggtacggccgtaggaccctaacgtacgttcgtacg

SEQ ID NO: 105167 - DNA, 701 bp, Homo sapiens
  misc_feature: GYAE6OF02JQT49.24.64.F09.1.454.CMB.1.raw
  modified_base (194)..(194): a, c, t, g, unknown or other
  misc_feature (194)..(194): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatccctcctgtctgcatctgtggganacagagtcaccatcacttgccgggcaaggtcagggctagttagaagtgagtttaggctggtatcaggacaagaaaccgagggaaacgaccccgtaaggtcctaggacttcgtaatcgacttgacctattaccccgtttaacaaacggttcggggtacccctaagtccgtaaacgggttccgaggtccgggacgtaaggtggtaacgttcgtagggaccaacgtagttaacttttccgaacgttacctaccaaccctaacgttccaacggacccgtaacgtcccgttcggaccacgtaccgttaggaaacgtacttaccgtttaggtaaacccttttaacgttaccgttaggttacctaaacgttaagtaacttttaaaccgtaacgtttaaccccgggttaggtaaccgtttacggaacccggtaacggtacccgtaaagggtacggaaacgttacggaaacgttaacgtacggttaggacgtcgaccgtaacctcgtacgttaccg

SEQ ID NO: 105168 - DNA, 513 bp, Homo sapiens
  misc_feature: GYAE6OF02HRR0Z.24.64.F09.1.454.CMB.1.raw
  modified_base (409)..(409): a, c, t, g, unknown or other
  misc_feature (409)..(409): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaccatcacttgccgggcaagtcagggcattagaagtgatttaggctggtatcagcagaaaccaggaaagcccctaaggtcctgatctatgctgcatcccgttacaagtgggtccatcagtcagcggcagtgatctgcacagatttcactctcaccatcagcagcctgcacgcctagaagattcttaggaactttattactgtactanagtattactaacgttaccgtggtaaccgttcggaccgaagggtacctaagggtaggaaactcggaaacgtaacgtggtaggccgtagacctaaccacttcttcg

SEQ ID NO: 105169 - DNA, 645 bp, Homo sapiens
  misc_feature: GYAE6OF02I61MI.24.64.F09.1.454.CMB.1.raw
  modified_base (194)..(194): a, c, t, g, unknown or other
  misc_feature (194)..(194): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtggganacagagtcaccatcacttgccggcaagtcgagggcattagaagtgatttaggctggtatcagcaagaaaccaggaaacgcccctaaggtcctgatcgtatgctgctacttacccgtttaagaaacggttcgggtacccattcgaaggttccagcggacgaggtggtactcgtggacacgtagtactttcacgtctaccacctatacagcacgcctacgccgtacgccgtaagacgtacgttacgttacggtaaacctttacgttaacgttcgttaacctaacgtaaacgttaactttaaccgtaaaccgtttacccggtacggttaacccggttaccgggacccgtaacggggtaaccgtaaacggggtaacggtaaaacgtacccggtaaaacggttaaccgttaggttacggtacgttacggacccgtaacctacgttcctttacccgg

SEQ ID NO: 105170 - DNA, 600 bp, Homo sapiens
  misc_feature: GYAE6OF02I6R3M.24.64.F09.1.454.CMB.1.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaccatcacttggccggcaagtcagggcattagaagtgagttaggcgtggtatcagcagaaaccagggaaacgacccgtaaggtccngtatctatactnctacttcccgttaagaaggtcgggtaccatacgaggttacagtcgcgtagtggatcgtcgacacagtatttcactcgtacacctatcacgcgacgtcctcgcacgtcctagaaatcttacgttagtaaactttagttacttacgttactaaacgtaagtaactttaacgttaaccgttacccggtacggtacccggttacggtaaccggtaaacgggtacgtaaagggttaacggaacgttaaccggaaacggttacgtaggtcggtacgtcgtacctaccgtacgttactgtttacccg

SEQ ID NO: 105171 - DNA, 638 bp, Homo sapiens
  misc_feature: GYAE6OF02I2200.24.64.F09.1.454.CMB.1.raw
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctcctgtctgcatctggtgggagacagacgtcaccatccacgttcgaccgggacaaggtcgagggcattaggagtgtatttagggcgtggtatcagcaagaaaccgaagggaacgaccccgtaaggtcctgactcgtatgctagcctacgttaccctttaacgaacggttcggggtaccctagtactaaggtcaggcgacggagtggagtcgtcggacacgtagtactttacacgttcctaccaaccacttacacgtctacgccgtacgtccaacgtccgtaggtaaagtacttacgttaacggtaaccttttattaccgttacgtaactacgtaaagttactttaacgtaacgtttaccggacggttaccggttaccggacggtaacggtacggaagggtaagggtaaaccgtacggaaacgtaccggtacgtcgtaccgtagtaccaaccttgtacccgtttacg

SEQ ID NO: 105172 - DNA, 723 bp, Homo sapiens
  misc_feature: GYAE6OF02HZBKY.24.64.F09.1.454.CMB.1.raw
  modified_base (220)..(220): a, c, t, g, unknown or other
  misc_feature (220)..(220): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtgggagacagagtcaccatcacttggccgggnaagtcagggcattagagtgatttaggctggtatcagcaagaaaccgagggaaacgaccccgtaaggtcctagactctatcgctgctacgttacccgtttaacgaaacggttcggggtaccccagttaccgtaaggtttccgaacggtccggacgtaaggtgggtaacgttcgtcggggacctaaccgtaacggttacttttacccgaaccttaccgtacccaaaccctacgttacccgaacggtccgtaaccggtacccgttcggaccctaacggtcccgttaaggtaacgttacgttacgtttaacgggtaaaccttttacgtttaacgttcggtaaccttaaacgtaagttaactttaaccgtaacgtttaacccgggtaggtaacccgtttaccgggacccgtaagggtaaccgtaagggtaacggtaaaccgtaccggaaaaccgtaacggttacggtacggtaccgtacggtaacccgtaccgtagttccgttaccgg

SEQ ID NO: 105173 - DNA, 692 bp, Homo sapiens
  misc_feature: GYAE6OF02G790T.24.64.F09.1.454.CMB.1.raw
  modified_base (194)..(194): a, c, t, g, unknown or other
  misc_feature (194)..(194): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccaaatgtgacatccagatcgacccagtctcctccaccctgtctgcatctgtagganacagagtcaccatcacttcggaccggacagtcagagttgttcgtgcgtgggtcgtcgtgtatcagcgaagaaccgaggaacgtacccttaatctgtactacgtagtaacggcgttacttaatttaacgaaggttccggggttacccttacgtaacggttcgaggtcggtacgtaggtaggtacgtcggtaagggtacaacggttaacgttctaacctcctactaactaactcgacgtacgacgtactacggctacgtccgttatacggttacgtttagttttacgaacctttaaactttacgtttaccgacgtaaccgtaactagttaacgtacggtacttaccgttaccttaacccgtcccgttacccgggtttaccggaaccgggttagggaacccgtacggtacgttacggaaaccttacgttaacgtacccggtaacgttgggttaaccgtcggttaccgtaccgttacccgtagtttaccctacggtttaccc

SEQ ID NO: 105174 - DNA, 610 bp, Homo sapiens
  misc_feature: GYAE6OF02HIHC9.24.64.F09.1.454.CMB.1.raw
  modified_base (194)..(194): a, c, t, g, unknown or other
  misc_feature (194)..(194): n is a, c, g, or t
  modified_base (384)..(384): a, c, t, g, unknown or other
  misc_feature (384)..(384): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtggganacagagtcaccatcacttgccgggcaagtcagggcattagaagtgatttaggctggtatcagacaaggaaaaccgaagggaaacgaccccgttaaagggtccctagaatactaatgctgctacttacccgtttaacaaaggtcggggtacccagtacgaaggttcaggcggcgagtggtatcgtggacanagtactttcaactctacacctatacagcagcctgcacgtcctagaacattacgttgtaaactttattactcgttactaacgtaagtaatttaacgtaacgtttaacccgggtggtaacgttaccgggaaccgaacggggaacccgtaaggggttaacggaaaacgtaccggtaaaaccggtaacgttaggtacggtccgtacggaccctaaccgtatccgtttacg

SEQ ID NO: 105175 - DNA, 683 bp, Homo sapiens
  misc_feature: GYAE6OF02FZTCS.24.64.F09.1.454.CMB.1.raw
  modified_base (298)..(298): a, c, t, g, unknown or other
  misc_feature (298)..(298): n is a, c, g, or t
  modified_base (402)..(402): a, c, t, g, unknown or other
  misc_feature (402)..(402): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcacatcacttgtggcaagtgacacctattagcagctctttgagttggcatcaattcaaaccgaggaacgcccctaacctcctagacttctacttacncgtccgtactaactttacacgtaggttcgggtacccagttaccctaggttcaggtggactaagtggatcgtagggactaggtacgttcaccttctacctaaccngtaccacgacgtacgtccacggaccctaacgttacggaaacgtttaccctttacggaccttaaaccgtttacttaagtttacgttaaccaaacgttaggttaacccggttttaacgtaccccgggttttaccccggtacctttaacccgggttacccggggtaaccggggaaccggggttaacccggtaaaggggtcgggtaaaccggttagtaacccgaacgttaaaccgtaacgttcgggaccggttacccgtaaggccccttaacggattttcccggg

SEQ ID NO: 105176 - DNA, 634 bp, Homo sapiens
  misc_feature: GYAE6OF02FWB7J.24.64.F09.1.454.CMB.1.raw
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggctcccaggtgccagatgtgccatccagatcgacccagtcctccactccctcctgtctgctatcgtggtgggacacagacgtccacatcacgttcggccgggactaagtcgagggctagttaagagtgtagtttacggctaggtatcgagcgaacgaaaccgagggaaaccgtaccccgttaaggtcctaggtatccttaagtcgcttcgaccttacctttacccggttaagaaacggttccggggtaccctaacgtcgtaacggttcgaggtccgtacgtaggtcggactcgtaggactaagtacgtactttcacctccacacgtanacncgtacacgtcncgcacgccgtagacgtcttacgttagtaacttactacgtgtactaatagtaacttaccgtaacgttcccggagttaaccggtacgaaccgtacggggacgtaacggtaacggaacgttaaccggaagttacggtgtcgacctacggacctactacgtacgttaccg

SEQ ID NO: 105177 - DNA, 654 bp, Homo sapiens
  misc_feature: GYAE6OF02G01C4.24.64.F09.1.454.CMB.1.raw
  modified_base (204)..(204): a, c, t, g, unknown or other
  misc_feature (204)..(204): n is a, c, g, or t
tcagactactatgtcacgaccggtgctcgatttagcgcgtatacaagggggcaggagtcagacccactcaggacacagcatggacatgagggtccccgctcagctcctggggctcctgctgctctggcctcccaggtcgccagatgtgccatccagatcgacccagtctccactccctcctgtctcgactatcgtggtaggganacaggtagtccaccattccacgttcgaccgggtataaggccgagggactaagttagagttacggtattaggcgttaggtactcgaggacaacgaaaccggacgggaaaccgtccccgtaaggtcctagactaccgtagtcgactagtcctacgttccccgttaaaggaacggttcgggaccctagtacgtacgttcgagcggtacgaggtcggattccggacgactaacgtagttatttccgacgttctaccaaccgtactacacgcacgtccgtcgacgtcgtactagaagttcgtacgttaagtacttacgtacttacgttaacaacgttaagtaacctttaacgtaaccgttacccggtaggtaccgttacgggaccgaacgggacgtaaagggtaacgtaaccgacgtaaccgtagtcgacgtcaacggactaccgtatcttaacg

SEQ ID NO: 105178 - DNA, 763 bp, Homo sapiens
  misc_feature: GYAE6OF02JGB96.24.64.F09.1.454.CMB.1.raw
  modified_base (98)..(98): a, c, t, g, unknown or other
  misc_feature (98)..(98): n is a, c, g, or t
  modified_base (135)..(135): a, c, t, g, unknown or other
  misc_feature (135)..(135): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
tcagactactatgtcacgaccggtgctcgatttagcgcgtatacaaggggcaggagtcagacccactcaggacacagcatggacatgagggtccccgntcagctctgggctcctgctgctctggctcccgaggtnccagatgtcgccatccagatcgacccagtctccatccctccgtgtctagcatctgngganacngagtcaccagtcacgtcggaccggacaagtcgaggcaagttacgaagtgtatttacggctaggtctcgagtacgaacgaaccggtaggtaaacgtccccgtaaaggtcctaggactcgtatcgtacgtgacctaccgttacccggttaacgaaaggttcccgggttacctaacgttacgtaacggttcaaggccggtagtacggtaggtcgtccgtggtactacgtagttaactttcaacgttcctaaccactagtaccgtaggcgtaaccgtccggtacgtacccgacggtaacccgtaaggtaacccgttacgttaccggttaacgtttaaaccgtttacgttaaccggttacgtaccgtttaaacgaacggttttaacctaacgtttaacccgtttaacccgggttacccggtaccggtttaaccgggaaacccggttacggtaaacccgggtaaacgggttaaccggtaaaaccggttaaccggtaaacggttaacccggttgggtaacccgggtccgttaaccgggacctaacccggtttacgttacccgtttaacccgg

SEQ ID NO: 105179 - DNA, 804 bp, Homo sapiens
  misc_feature: GYAE6OF02IB0AQ.24.64.F09.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (436)..(436): a, c, t, g, unknown or other
  misc_feature (436)..(436): n is a, c, g, or t
  modified_base (782)..(782): a, c, t, g, unknown or other
  misc_feature (782)..(782): n is a, c, g, or t
  modified_base (788)..(788): a, c, t, g, unknown or other
  misc_feature (788)..(788): n is a, c, g, or t
tcagactactatgtcacgaccggtgctcgatttagcgcgtatacaagggggcaggagtcagacccactcaggacacagcagtggacatggacgggtccccgctcagctcgtgggctcctgctgctcgtcggcctcccgaggtcgccaggatcgtcgccagtccagtactcgaccctagtcctccacttccctccctgtctcgctattcgnggtcggagacagacgtccactntcacgtcggacggtacaggtcgagggtactaagttacggtagtactaggtttagcgttagtacgacgaacggtaaccgaaacggtaaaccggaaaccgggtacccctaccccggttaacggtaccctaggtaacttctaacgttcggactaaccgtccgtttaaccgttaaccggtttaaacggaaccggggttccggtaaccngttaaccgggtaacttaccgggcgggttaccgaacggtttagggtaccggtacgttacgacggggaaccctaaggtttaccccgttaacgttttaccccgaacctttacccgttaacaccccgtaaaagggttcccaaccggtaccctaaccggtccggtaaaccggttcccgaaaccggttacgtaaaccgggttaacttacggtttaaacgttacgtttaaacgtaccgtttacgttactaaccgttaacggtaactttaacgttaacccgtcgttaccgggttacgtaccggacgtaaccggacgtaaggtaccggaagttaaccgtcgaaacgtgtacggcncgtacncggcttacgttctcgg

SEQ ID NO: 105180 - DNA, 737 bp, Homo sapiens
  misc_feature: GYAE6OF02HPT1L.24.64.F09.1.454.CMB.1.raw
  modified_base (200)..(200): a, c, t, g, unknown or other
  misc_feature (200)..(200): n is a, c, g, or t
tcagactactatgtcacgaccggtgctcgatttagcgcgtatacaagggggcaggagtcagacccactcaggacacagcatggacatgagggtccccgctcagctccgtgggctcctgctgctctggctcccaggtcgccagatgtcgccatccagatcgacccagtctccatccctcctgtctgacagtctggtggganacgagactacaccatcacgttcggaccggacaagtcgaggtctaagttagagtgtacttaggcgtaggtatcgagtacgaacgaaaccgaagggaaaccgaccccgtaaggtcctaggacttctagtcgctgtacgtacttacccgttaagaacggttcggggtacctagtacgtacggttcgacggcgacgtgtacgatcgtacggtacagtacgtactttaccgtacctacctaccaccctaagttcccgagtaccgtaccgtccgttcgaccgtaccgccttaaggaacgtaccgtttagttacgggtaaacttttacgttaacgtaccgttaacgtaacgtaacgtttaaccgttaacgtttaaacccgttaccgggtaaaccgggttaccgttaacccggggtaacccgggtaacggggtaacccgggtaaacgggttaacgggaaacccgttaaccgggtaaaccggttaacccgtagggttacccggtacgtacggaccccgttaaccgttacgttacccggtttacccg

SEQ ID NO: 105181 - DNA, 492 bp, Homo sapiens
  misc_feature: GYAE6OF01BBN19.29.71.G05.1.454.CMB.1.raw
tcagatagagtactcacgaccggtgctcgatttagtgtcgtcgcaagagagaggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagcgttatttggagtgccagacaggctcagtggcagcgggtcagggacagatttcacactgaaatcagccgggtggaggctgaggatgcgtggctatttattattgcatgactaaagtttacagtcttgttctacgttttggcctaggggtaccatccgtggactagtaaccg

SEQ ID NO: 105182 - DNA, 520 bp, Homo sapiens
  misc_feature: GYAE6OF01D5ESN.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttangtaagtttccaagtcgtttattttggagttgccagacaggctcgagtggcaggcgggtcgagggacagatttcacactagaaatcaggccgggtggaggcgtggaggagtgttggctatttattattgactatgactaaagttacagtcgttgttactacgttttcggaccgtaggggacctagtaccgtaggaactagtacgtaaaacg

SEQ ID NO: 105183 - DNA, 536 bp, Homo sapiens
  misc_feature: GYAE6OF01CM10V.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagcctatatgtactggtacctgcagaagtcaggccagcctcacgactcctgatttatgtaagtttccaagtcgttaattttgggagttgccagacaggctcagtggcagcgggtcgagggacagatttcacactagaaatcgaggccgggtggaggcgtggaggtagtggttggctaattttagttatttgactatgtacgtaaagtttacgagtcgttgtttactacgttttcgggaccgtaggggtaccctagttccgtagggaaccattaccgtaaaaccgg

SEQ ID NO: 105184 - DNA, 515 bp, Homo sapiens
  misc_feature: GYAE6OF01EU007.29.71.G05.1.454.CMB.1.raw
  modified_base (507)..(507): a, c, t, g, unknown or other
  misc_feature (507)..(507): n is a, c, g, or t
tcagatagagtactcacgaccggtgctcgatttagtgtcgtcgcaagagagagggggacgtgatcaggacttctcagttcatcttctcaccatgaggctccctgctcagctcctgggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaagtcgtttattttggagtgccagacaggctcagtggcagcgggtcgagggacaggatttcacactagaaaatcagccgggtggaggctggaggatggttggctatttattattgctatgtactaaagtttacagtcttgttctacgttttcgggccgtaggggtacccacttaccgtgggaacngtaaaccg

SEQ ID NO: 105185 - DNA, 511 bp, Homo sapiens
  misc_feature: GYAE6OF01DXNWO.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaagtcgtttattttggagtgccagacaggctcgagtggcagcgggtacagggacagtatttcacactagaaatcaggccgggtggaggcgtgaggattggttggactattttattagttgctatgactaaagtttacagtcttgttctcgttttggccgacggggtaccactccgtaggcagtaaccg

SEQ ID NO: 105186 - DNA, 490 bp, Homo sapiens
  misc_feature: GYAE6OF01A2ZFG.29.71.G05.1.454.CMB.1.raw
  modified_base (486)..(486): a, c, t, g, unknown or other
  misc_feature (486)..(486): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacagccggcctccatctcctgcaagtctagtcagagcctcgtgcatagtgatggaaagcctatatgtactggtacctgcagagtcaggccagcctccacgactcctgatttatgtaacgtttccaagtcgtttagtttggagtcgccagcaggctcgagtgcagcgggtnaggg

SEQ ID NO: 105187 - DNA, 501 bp, Homo sapiens
  misc_feature: GYAE6OF01BWJY0.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctgggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgttatttggagtgccagacaggctcagtggcagcgggtcagggacagatttcacactagaaatcagccgggtggaggcgtgaggatgttggctatttattattgcatgctaaagtttacagtcgtgttctacgttttggcccgtaggggacccagttcctaggactagtcgtaaaacg

SEQ ID NO: 105188 - DNA, 666 bp, Homo sapiens
  misc_feature: GYAE6OF01BYIV0.29.71.G05.1.454.CMB.1.raw
  modified_base (257)..(257): a, c, t, g, unknown or other
  misc_feature (257)..(257): n is a, c, g, or t
tcagatagagtactcacgaccggtgctcgatttagtgtcgtcgcaagagagaggggtactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaanacctatatgtactgtacctgacagaagtcaggccagcctcacgactctgtatttagtgtaacgtttaccaaggtcgtttaagttttggaagttcgcccaagacgaaggtccttacgaggtcggacgagggtcgggtacgaacgggaacgtaaggtactttaccgaacgtaacgttaacgtaaaattccgaacgggtcccggggttaagggaacgggtacggtaggaacgggtagttagggtttacggtacttaagttttaagtttagtttacggtactaagtacggtaacgttaaaacggtttaacgtaacggttccgttaggttttaccgttacgtttttacgggaccccggttaagggggtaacccctagttaccccggtacgggtaaccgtaacgttaaaacccgg

SEQ ID NO: 105189 - DNA, 528 bp, Homo sapiens
  misc_feature: GYAE6OF01BJTCD.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccgcctcatctcctgcaagtctagtcagagcctcgtgcatagtgatggaaagacctatatgtactggtacctgcagaagtcaggccagcctccacgactcctgatttatgtaagtttccaagtcgttattttggagtgccagacaggctcgagtggcagcgggtcgagggacagtattcacactagaaatcaggccgggtaggaggcgtggaggtatgttggactatttattattgactatagtactaaagtttacagtcttgttactacgttttcgggaccgtaggggtaccctacgttacccgtaggacctaagtacgtaaaaccgg

SEQ ID NO: 105190 - DNA, 551 bp, Homo sapiens
  misc_feature: GYAE6OF01BR62V.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgaccagactccactctctctgtccgtcacccctggacacgccggcctccatcctcctgactaagtctagtcagacgtcctgtgctatagtgataggaaacacctaatagtgtaactggttacctgacaagaacgtcgacggccacgccctaccaaccgtacctcctagtaactttagacgtaagtttaccaaggttcgttagttttacggagttcgacaggtaccagggtccttacgaggttcggaccgtacggtcgggtcgtaaacgggg

SEQ ID NO: 105191 - DNA, 520 bp, Homo sapiens
  misc_feature: GYAE6OF01B0DI1.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaagtcgtttatttggagtgccagacaggctcgagtggcagcgggtcagggacagtatttcacactagaaatcgacggcgggtggaggctggaggatgtggactagtttattattgactatgactaaagtttacagtcgttgttactacgttttgggaccgtaggggaccctagtccgtaggactagtacgtaaaaccgg

SEQ ID NO: 105192 - DNA, 525 bp, Homo sapiens
  misc_feature: GYAE6OF01DS8PP.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaacgtttccaagtcgtttattttggagtgccagacaggctcgagtggcgagcgggtcgagggacaggtatttcacactagaaatcgagcgggtggaggcgtggagagtgttggctatttattattgactagtgactaaagttacagtcgttgttcttacgtttcggaccgtaggggtaccctagttccctaggactacgtacgtaaaaccgg

SEQ ID NO: 105193 - DNA, 600 bp, Homo sapiens
  misc_feature: GYAE6OF01CN5YU.29.71.G05.1.454.CMB.1.raw
  modified_base (212)..(212): a, c, t, g, unknown or other
  misc_feature (212)..(212): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtccttgctaatgctctggatacctggatcagtggagatattgagatcgaccagacctccactctcttctcgtccgtccaccccgtggacacggcccggcctccatcctacctgactaagtctagtcacgtacgcctacgtgactagtaggtacgaagtaacgggaaaacgtaccttaagttaattcgtaacgttggtaccctgacgaagaacgtcgacggaccacgcctaccacgtaccttaccgtagttaactttactacggtaactttaccgtaaggttacgttttagtttgggaagttccgtaccaaggtcctacgggtactccggtaagggttcggacgacggggtcccgggtaagaacgggg

SEQ ID NO: 105194 - DNA, 529 bp, Homo sapiens
  misc_feature: GYAE6OF01B9VCO.29.71.G05.1.454.CMB.1.raw
  modified_base (421)..(421): a, c, t, g, unknown or other
  misc_feature (421)..(421): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaaagtcgtttattttggagtcgccagacaggctacgagtggcaggcgggtcgagggacagtattcactactagaaatcaggccgggtggaggcgtgaggtntggttggactagtttattattgactatgactaaagttacagtcttgttactacgttttcggaccgtaggggacctacgttaccgtaggtactagtaacgtaaaaccgg

SEQ ID NO: 105195 - DNA, 544 bp, Homo sapiens
  misc_feature: GYAE6OF01CMXQK.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccgcctcatctcctgcaagtctagcagagcctcgtgcatagtgatggaaagacctatatgtactggtacctgcagaagtcaggccagcctccacgactcctagtactttatgtaacgtttccaaggtcgtttattttggagtgccagaccaggctcgagtcggcaggcgggtcgagggacagtatttcactactagaaatcgacggccgggtaggaggcgtaggaggtgttggtggtctagtttattattgtctagtgactaaagtttacagtcgttcgttacttacgttttcgggaccgtacggggtaccctacggttaccgtggtaactacgtactaaaacgg

SEQ ID NO: 105196 - DNA, 616 bp, Homo sapiens
  misc_feature: GYAE6OF01DRQ2S.29.71.G05.1.454.CMB.1.raw
  modified_base (312)..(312): a, c, t, g, unknown or other
  misc_feature (312)..(312): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctgacagccggcctcatctcctgcaagtctagtcagacgcctcgtgcatagtgataggaaagacctatatgtactggtacctgcagaagtcaggccagccctccacgactcctgtatttangtaacgtttccaaaggtcgtttaattttgggagttcgccagacagggctcgagtcggcgaggcgggtcgagggacagtatttcaactactaagaaaactcgaacggccggggtagggaggtcgtagggaaggtaagttcgggtttaggtacgttaagttttaagttatttaggtcgtaagttacggtaactaaaaggttttaccgaaggttccgtttaggtttaccttacggtttttcgggacccggtaaccgggggtaccctaacgttcccgtaagggaacttaaacgtacgtaaaaacccgg

SEQ ID NO: 105197 - DNA, 539 bp, Homo sapiens
  misc_feature: GYAE6OF01B4785.29.71.G05.1.454.CMB.1.raw
  modified_base (312)..(312): a, c, t, g, unknown or other
  misc_feature (312)..(312): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgcagaagtcaggccagccctccacgactcctgatttangtaacgtttccaagtcgtttatttggagtcgccagacaggctcgaggtggacgaggcgggtacgagggacagtattacacactagaaatcgaggccgggtaggagggcgtaggagggtagttggttggtactagttttattagttgactagtagtactaaagttacagtcgttagttctacgtttggaccggtagggacctagtaccgtaggactagtacgtaaacg

SEQ ID NO: 105198 - DNA, 529 bp, Homo sapiens
  misc_feature: GYAE6OF01BW9H7.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacacgcccggcctccactctcctgcaagtctagtcagacgcctcgtgcagtagtgataggaaatacctatatcgtactggtacctgacagagtcaggccagccctccacgacctccgtagtatttatgtaacgtttaccaaggttcgtttagtttggagttcgaccgaggacagggtctacgaggttcggaccgaggtccggggtgaacgggg

SEQ ID NO: 105199 - DNA, 514 bp, Homo sapiens
  misc_feature: GYAE6OF01BT0O1.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagacctccactctctctcgtcccgtcacccctggacacgcccggcctccatctcctgacagtctagtcagacgcctcgtgcatagtgataggaaagcctatatgtactggtacctgacaagagtcgacggccacgcctccaccgactcctagtatttagtagtaactttccaagtcgtttagtttggagtcgcaggcaggctacgaggtcggacgaggcgggtcgaggg

SEQ ID NO: 105200 - DNA, 536 bp, Homo sapiens
  misc_feature: GYAE6OF01AQ0IV.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgtttattttggagtgccagacaggctcgagtggcagcgggtacagggacagtatttcaactactagaaactcgacggccgggtaggaggctaggaggtagttggttggacttaagttttagttattgactagtgactaaagtttacagtcttagttctacgttttgggacccgtacggggtacctagttcccgtaggtactagtaaaccg

SEQ ID NO: 105201 - DNA, 704 bp, Homo sapiens
  misc_feature: GYAE6OF01C1H43.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggactcaggtggagatattgagatcgacccagacctccactctctctcgtccgtccaccccgtggaccacggcccggcctccacttcctcctgaccaagtcctagtcagacgcctcgtgactagtaggtagagtagggaaaactaccttatagtagtacgttcggtaacctgaccaagaacgtcgacggaccacgccctaccgaacgtaccttccgtagttaatttagtacggttaaacgttttaccgaaaggttcgttttaaggtttcgggaaggttcgaccgtaaggtacgacggtccgtacgtaaggggtcggacgacgggtacgggtacggaacgggacgtaacggtactttacgaaccgtaacgtaaacgaaaactcggaacgggtaccgggggtagggacggtacggtagggagggtagttgggttaggtacgttaagttttagttacgttgtactagtcgtaacgttaaacgttacagtccgtttacgttacgttacggttttccggaccggtaacggggtacctacgttaccgtaggaacctaacgtaaccgtaaaacgg

SEQ ID NO: 105202 - DNA, 533 bp, Homo sapiens
  misc_feature: GYAE6OF01CUAMS.29.71.G05.1.454.CMB.1.raw
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (473)..(473): a, c, t, g, unknown or other
  misc_feature (473)..(473): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatgacccagactccactctctctgtccgtcacccctggacagccggcctccatctcctgcaagtctagtcagagcctcgtgcatagtgatggaaanacctatatgtactggtacctgcagaagtcaggccagcctccacgactcctgatttanagtaagtttccaagtcgttaattttgggagtgacctagacaggctcgaggtggcgaggcggtcgagggacagtattacacatagaaaatcaggccggtggaggcgtaggaggtagtggttggactaatttaattagttagctatagtactaaacgtttanagtcttgttactcgttttacggaccgtacggggtacctagtccgtagacgtaagtaaccg

SEQ ID NO: 105203 - DNA, 520 bp, Homo sapiens
  misc_feature: GYAE6OF01CVFHV.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagccctccacgactcctgatttatgaagttttccaagtcgtttattttggagttgccagcaggctcagtggcaggcgggtcgagggacagatttcacaactgaaatcgaggccgggtggaggctggagggatggttggctattttattattgctatgactaaagttacagtcttgttctacgttttcggaccgtaggggaccctagttcccgtaggacagttcgtaaaaccgg

SEQ ID NO: 105204 - DNA, 556 bp, Homo sapiens
  misc_feature: GYAE6OF01DYZVL.29.71.G05.1.454.CMB.1.raw
  modified_base (312)..(312): a, c, t, g, unknown or other
  misc_feature (312)..(312): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaagacctatatgtactggtacctgcagaagtcaggccagcctccacgactcctgatttanagtaacgtttccaagtcgtttagttttggatcgccagcaggctcgagtggcaggcgggtcgagggacagtatttcaacactagaaatcgaggccgggtggaggcgtaggaggtagttggttggtacttaagttttattagttgtactagttgtaacgttaaagtttacgagtcgttcgtttacttacgttttcgggaccgtacggggaccctagttcccgtaggtaacctagtacgtaaaacgg

SEQ ID NO: 105205 - DNA, 536 bp, Homo sapiens
  misc_feature: GYAE6OF01ETIB3.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaaagtcgtttatttgggagttcgccagacaggtctgaggtggcaggcgggtacagggacagtatttcactactagaaatcgaggccgggtaggacggtcgtaggaggtagtggttaggacttagttttaattagttgactagtgactaaagtttcagtcgttgttctacgtttggaccgtagggacctacgtccgtaggactagtacgtaaaacg

SEQ ID NO: 105206 - DNA, 539 bp, Homo sapiens
  misc_feature: GYAE6OF01BGC8H.29.71.G05.1.454.CMB.1.raw
  modified_base (253)..(253): a, c, t, g, unknown or other
  misc_feature (253)..(253): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaanacctatatgtactggtacctgcagaagtcgaggccagcctccacgactcctgtatttatgtaacgtttccaagtcgtttagtttggagtcgccagacaggctcgagtggcaggcgggtcgagggacagtatttcactactagaaactcgaggccgggtaggacggcgtaggaggtgttgttaggtctagtttattattgactagtagtactaaagtttacagtcgttgttacctacgttttcggaccgtaggggacctacgtccgtaggactagtacgtaaaccgg

SEQ ID NO: 105207 - DNA, 543 bp, Homo sapiens
  misc_feature: GYAE6OF01D0FQG.29.71.G05.1.454.CMB.1.raw
  modified_base (215)..(215): a, c, t, g, unknown or other
  misc_feature (215)..(215): n is a, c, g, or t
  modified_base (274)..(274): a, c, t, g, unknown or other
  misc_feature (274)..(274): n is a, c, g, or t
  modified_base (323)..(323): a, c, t, g, unknown or other
  misc_feature (323)..(323): n is a, c, g, or t
tcagatagagtactcacgaccggtgctcgatttagtgtcgtcgcaagagagagggggtcaggctggaactgaggagcaggtgggggcacttctccctctaacactcctcccctgttgaagctctttgtgacgggcgagctcaggccctgatgggtgacttcgcaggcgtagacttttgtgtttctcgtagtctgctttgctcagcgtcgagggtnctgctgaggctgtagtgctgtcctgactaatgctctggactaccgtggatcgagtgganatatgagatcgaccagacctccactctcgtctcgtcctcacccgtgacncgccgctccatctcctgacaagtctagtcagcgtcctcgtgactagtagtagagtagggaaactaccttaatagtacggtactgggtaccctgacaagtaacgtcgaacggtcccagccctaccgacgtacctcgtagtattagagtacgttcaagtcgtttagttggagtcgaccgaggactcgggtctacgtaggtcggacacgggtcggacgaaggg

SEQ ID NO: 105208 - DNA, 589 bp, Homo sapiens
  misc_feature: GYAE6OF01CM54A.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctgtgcatagtgatggaaagacctatatgtactggtacctgcagaagtcaggccacgccctccacgactcctgtatttatagtaacgtttaccaagtcgtttagttttggagtcgaccagacaggtctacgagtggcgaggcgggtacgagggacagtattcactactagaaatcgaggccgggtgggaggcgtaggagggtagttggttaggtacgttatttttaagtttagttcgactaagttacggtaacttaaaaggtttacgaaggttcgttaggtttaccgttacggtttttcgggacccgtacggggtaaccctacggttacccgtacggtacgtaacgttaaacccg

SEQ ID NO: 105209 - DNA, 622 bp, Homo sapiens
  misc_feature: GYAE6OF01BLLUC.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacacgccggcctccgatcctcctgactaagtctagtcaggacgcctgtgctatagtgagtaggaaactactatagtgtactggtacctgacaagacgtcaggccagcctccacgtactctagatttagagtacgtttacaagtcgtttagtttggagtcgacagacagtctgagtgacgaggcggtacgaggactagtatttacactactaagaaagtcgaacggtccgggtaggaggtacgtaggtaggtagttagggttacggtacgtttaagttttaagtttaacgttagacttaagttacgtaacgttaaaacggtttaaccgacggttaccgtttagttaccgtttaccggttttaccggggaaccgtaaccgggggtacccttacggttacccgtacgggtaaccgtaagttaaacccg

SEQ ID NO: 105210 - DNA, 534 bp, Homo sapiens
  misc_feature: GYAE6OF01AOBP0.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagccctccacgactcctgtatttatgtaagtttccaagtcgttattttggagtgccagacaggctcagtggcgaggcgggtacagggacagtatttcactactagaaatcgaggccgggtaggacggtcgtaggagggtatggttaggactagttttattattagctatgtataaagtttacagtcgttgttctacgttttcggaccgtaggggacctacgtccgtaggaactagtacgtaaaaccg

SEQ ID NO: 105211 - DNA, 488 bp, Homo sapiens
  misc_feature: GYAE6OF01CYB4R.29.71.G05.1.454.CMB.1.raw
  modified_base (187)..(187): a, c, t, g, unknown or other
  misc_feature (187)..(187): n is a, c, g, or t
  modified_base (310)..(310): a, c, t, g, unknown or other
  misc_feature (310)..(310): n is a, c, g, or t
  modified_base (446)..(446): a, c, t, g, unknown or other
  misc_feature (446)..(446): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtnacccctggacagccggcctccatctcctgcaagtctagtcagagcctcgtgcatagtgactggaaagcctatatggtactggtacctgcagaagtcaggccagcctcacgactcctgatttangaagtttccaagcgttatttggagtgctagacaggctcagtgcagcggtacagggacagattcacactgaaatcagccggtgagctgagatgtagcgtattagttaatgactatgtctaaagttcagtacctgttntacgtttcgccgtaggaccgtactacctggacatcgtaaacg

SEQ ID NO: 105212 - DNA, 595 bp, Homo sapiens
  misc_feature: GYAE6OF01D0O2P.29.71.G05.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacacgccggcctccatcctcctgacaagtctagtcagngcctcgtgcatagtgagtaggaaacgtacctatatgtactggtacctgcaagaagtcacggccacgccctaccacgtacctcctntaatttatagtaactttaccaaagtcgtttagtttggacgtcgcctaagacaggctagagtggcaggtcgggtacgaaggacagtattaccaacgtactaagaaatcgaacggtccggggtaggaggtcgtaggaggtagttcggttaggacttaatttaagttagtacgactagtcgtaagtaaaacgtttacaacgttcgttacgtttagttacgtttcggaccggtaacgggtaccctaacgttccgtaggaacctaagtaaccgtaaaaccgg

SEQ ID NO: 105213 - DNA, 510 bp, Homo sapiens
  misc_feature: GYAE6OF01EB27C.29.71.G05.1.454.CMB.1.raw
  modified_base (440)..(440): a, c, t, g, unknown or other
  misc_feature (440)..(440): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctcgtccgtcacccctggacagccggcctccatcctctcgcaagtctagtcagacgcctcgtgcatagtgataggaaactacctatatgtactggtacctgacagagtcgaggccagccctccacgacctcctgtatttangtaagtttccaagtcgtttatttgggagttcgaccagacaggtctcgagtcgganagggcggtnaacggg

SEQ ID NO: 105214 - DNA, 594 bp, Homo sapiens
  misc_feature: GYAE6OF01DHX51.29.71.G05.1.454.CMB.1.raw
  modified_base (246)..(246): a, c, t, g, unknown or other
  misc_feature (246)..(246): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagngataggaaagacctatatgtactggtacctgacagagtcaggccagcctaccacgacctctagtatttagagtaacgtttccaaagtcgtttagttttggagtcgaccagtacgagtactcgaggtcggacgaggcgggtacgagggacagtattacaactacgtaagaaatcgaggtaccgggtaggaggtacgtgggaggtacgttggttacggtacgttaattttaagttagtttagaccgtagttacgtaacgttaaagtttaccgagttcgttagtttacgttacgttttacgggaccgttacggggtaccctagttcccgtaggtaaccgtagtaaacccgg

SEQ ID NO: 105215 - DNA, 571 bp, Homo sapiens
  misc_feature: GYAE6OF01BO4F0.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtcctgctaatgctctggatacctggatccagtggagatattgagatgacccagactccactctctctcgtcccgtccaccccgtggacacgcccggcctccactcctcctgcaagtctagtcagacgcctcgtgcaagtgtagtaagtaggaaacgtaccttaagtaacgtgttaacctagggtaccctggaaccaagaacgtccgacggcccacgccctacccacgtacctcctagttatttacgtagtaacgtttccgaagttcgtttagtttacggacgttcgaccgaggtaccagggtctacggtaggtcggagacgggtcgggtacgaacggg

SEQ ID NO: 105216 - DNA, 579 bp, Homo sapiens
  misc_feature: GYAE6OF01CNMKA.29.71.G05.1.454.CMB.1.raw
  modified_base (340)..(340): a, c, t, g, unknown or other
  misc_feature (340)..(340): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatgacccagactccactctctctgtccgtcacccctggacacgccggcctccatcctcctgctaagtctagtcagacgccctcgtgcaataggtgaagtaggaaaacgtacctatatgttacgtcggtacctgacagaagtcgaggccacgccctaccgaccgtactcctagtaatttanagtaacgtttccaagttcgtttagtttggagtcgaccagacgaggtctcgaggtggcgaggcggtacgaggactagtattacgaactactaagaaatcgacggtcgggtaggaggcgtagacggtattggttaggtacttatttagttatgactagtgtaactaaagttacgacgtcgttagtacgttacgtttacggaccggtagggtacctacgtaccgtaggaactacgtaaaccg

SEQ ID NO: 105217 - DNA, 631 bp, Homo sapiens
  misc_feature: GYAE6OF01AR1QQ.29.71.G05.1.454.CMB.1.raw
tcagatagagtactcacgaccggtgctcgatttagtgtcgtcgcaagagagagggggtcaggctggaactgaggagcaggtgggggcacttctccctctaacactctccctgttgaagctctttgtgacgggcgagctcaggccctgatgggtgacttcgcaggcgtagactttgtgtttctcgtagtctgctttgctcagcgtcagggtgctgctgaggctgtaggtgctgtcctgctaatgctctggatacctggatccagtggagtatattgagatcgaccagacctccactctctctcgtcccgtccacccctggaccacgcccggcctccgatcctcctgctaacgtctagtcagacgtcctcgtgactagtagtgaatagggaaactaccttaattacgtacgttacctacgggttaacctcggacgtaagaacggttcgaacgggtcccacgtacccgtaccccgaaaccggtaccttaccctaggttaatttttaacgtacggttaaaccttttcccggaaagttccggttttaaagtttcggggtaaacgttccggtacccgtaaggtaccgtaacgggtcttacgtacgggtcgtacgacgggtcggggtacgtaacgggg

SEQ ID NO: 105218 - DNA, 522 bp, Homo sapiens
  misc_feature: GYAE6OF01AN7ZR.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctcacgactcctgatttatgaagtttccaagtcgttattttggagtgccagacaggctcgagtggcaggcgggtcagggacagatttcacactagaaatcgaaggcccgggtaggaggcgtggaggatgttggctagttttattattgcagtgacgtaagtttacagtacgttgttctacgttttcggcccgtaaggggtaccctagtacccgtaggactagtacgtaaacg

SEQ ID NO: 105219 - DNA, 579 bp, Homo sapiens
  misc_feature: GYAE6OF01DIQSP.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgcagaagtcaggccagccctccacgacctcctagatttatgtaacgtttccaagtcgtttagttttggagtgaccagacaggctgagtggcgaggcgggtcgagggacaggtatttacacactagaaatcgaggccgggtaggacggcgtagggaggtagttggttagggtacttaagtttttattagtttcggtacgtattaggtaacttaaagtttacgtaggtcgtttagtttaccgttacggttttcgggaccggtaacggggtaccttaacgtcccgttaggaccgtagtaaacccgg

SEQ ID NO: 105220 - DNA, 505 bp, Homo sapiens
  misc_feature: GYAE6OF01D8M8G.29.71.G05.1.454.CMB.1.raw
  modified_base (430)..(430): a, c, t, g, unknown or other
  misc_feature (430)..(430): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacacgccggcctccatctcctgcaagtctagtcagacgcctcgtgcatagtgatggaaagcctatatgtactggtacctgcagagtcaggcagcctccacgctcctgtatttangtacgtttccaagtcgtttagtttgggagttcgaccaggtcaggtctacgaggtggacaggcgggtcgaacgggg

SEQ ID NO: 105221 - DNA, 617 bp, Homo sapiens
  misc_feature: GYAE6OF01EKU2F.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgatggaaagacctatatgtactggtacctgcagaagtcaggccagcctcacgactcctgtatttatgtaacgtttccaagtcgtttatttggagtcgccagacaggctcgagtggcaggcgggtacgagggactagtactttacaacgtactaagaaaactcgagggcccgggtaggaggtcgtaggagggtagttggtttaggacttagtttttaatttagtttaggacttaagttacgtaaccgttaaaaggttttaacccgaaggttaccgtttcgttttaccgttaaccggttttttcggggaacccggttaacggggtaacccctagttacccggtaggtaacctaacgtaaccgtaaaaacccggg

SEQ ID NO: 105222 - DNA, 563 bp, Homo sapiens
  misc_feature: GYAE6OF01AFRBV.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctgggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtactttatgtaacgtttccaagtcgtttagtttggagtcgccagacaggtctcgagtggcaggcggtcgagggacagtatttcactactagaaactcgaggccgggtaggaggtcgtaggaaggtagttggttaggcgttaagttttagtttaagttgtacctagtacgtactaaagtttacgagtcgttacgttagttacgttttcgggacccgtacggggacctacgttaccgtaggtaactacgtacgtaaaaccgg

SEQ ID NO: 105223 - DNA, 530 bp, Homo sapiens
  misc_feature: GYAE6OF01DSYA3.29.71.G05.1.454.CMB.1.raw
  modified_base (309)..(309): a, c, t, g, unknown or other
  misc_feature (309)..(309): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctcacgactcctgatttangaacgtttccaagtcgtttatttggagtgccagacaggctcaggtggcagcggtcgagggacagtatttcacactagaaatcgaaggccgggtggaggctggaggagtggttggactattttagttattgctagtgaactaaagtttacgagtcgttgttcttacgttttcgggaccgtacgggtaccctacgtaccgtaggaactagtaccgtaaaacgg

SEQ ID NO: 105224 - DNA, 561 bp, Homo sapiens
  misc_feature: GYAE6OF01EZRVY.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaagtcgtttattttggagtgccagacaggctcgagtggcaggtcgggtacagggacagtatttacacactagaaaatcgacggccgggtggaggtcgtaggaggagttggttcggacttaagttttagttaagtttgactagtacgtactaaaaggtttacaggttcttaggtttacctacgttttcgggacccgtacggggtaccctacttacccgtagggtaacctagtaaacccg

SEQ ID NO: 105225 - DNA, 646 bp, Homo sapiens
  misc_feature: GYAE6OF01EEEXT.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtccacccctggacacgccggcctccatcctcctgacaagtctagtcagacgcctcgtgacatagtgagtaggaaacgacctatatgtacgtggtacctgacaagagtcgaggccacgcctccacgtacctccgtagtatttatgtaacgtttccaagttcgtttagtttgggagttcggaccagacgtacggtctcgaggtcggacgacggcggtacgagggacagtacttcaactactaagaaactcgacggtacggggtggaggtcgtaggtacggtagttgggttacggtacgttaagttttaacgtttacggttacgtactacggttagtaaaccgttaaacggttttaaccgaaggttacgtttacggttttaccgttacgggtttttaccggaccgggtaaccgggtaccgttaccgttaccggtaggtaaccttaacgtaccgtaaaaaccgg

SEQ ID NO: 105226 - DNA, 543 bp, Homo sapiens
  misc_feature: GYAE6OF01AUBLF.29.71.G05.1.454.CMB.1.raw
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagcctatntgtactggtacctgcagaagtcaggccagcctccacgactcctgtatttangtaagtttccaagtcgtttagtttggagttgcctagacaggctcgagtggcgaggcgggtacgagggacagtatttcactactagaaagtcgaggccgggtaggaggcgtaggaggtagtggttggtactaagttttattagttgctagtgtacgtaaagtttacgagtcttggttcttacgttttcggaccgtacggggtacctacgttcgtaggaactagtacgtaaacgg

SEQ ID NO: 105227 - DNA, 651 bp, Homo sapiens
  misc_feature: GYAE6OF01DSE59.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtcccgtcacccctggacagcccggcctccatcctcctgccaagtctagtcagagcctcgtgcatagtgataggaaacgacctatatgtactggtacctgcagaagtcaggccagccctccacgtacctcctgtaactttagtcgtaacgtttccaaaggttcgtttagttttggacgtgacccagacaggctcgaggtggacagggcgggtacgagggaacagtacttacaactacgtaagaaacttcgacgggtccggggtaggacggtcgtagggaggtaagtttgggttacggtactttaagtttttaacgttagtttacggcgtaaaggttccgtaaacgttaaaaacgggttttcacggttaccgttttaggtttaccgtttaaccgggtttttcgggacccggtaaaccgggggttaaccctacggttcccggtaacgggtaaccttaaacgtaaaacccgg

SEQ ID NO: 105228 - DNA, 624 bp, Homo sapiens
  misc_feature: GYAE6OF01BHVTG.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatgacccagactccactctctctgtcccgtccaccccgtggacacgcccggcctccatcctcctgcaagtctagtcagtttacgcctcgtgcatagtgataggaaagacctatatgtactggtacctgcagagtcacggccacgccctccacgtactcctgtatttatagtaacgtttccaagttcgtttagttttggagttcgaccaagtacgaggtctacgaggtcggcgagggtccgggtacgaagggactagtactttaccaactaactaagtaaactcggacgggccgggtaggacggtcgtaggaggtgttggttaggtactttaagttttaatttagttgtacgtaagttacgtaacgtttaaaagtttacgagttcgtttagtttaccgttacggttttaccgggaccggtaacggggtaaccctacgttacccggtacggtactaacgtaaaccg

SEQ ID NO: 105229 - DNA, 625 bp, Homo sapiens
  misc_feature: GYAE6OF01AN3GG.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaagacctatatgtactggtacctgcagagtcaggccagccctaccacgactcctagtatttatagtaacgtttaccaaggtcgtttagttttggagttcgacccgtagacgtaggtcctacgaggttcggacgtacgggtccgggtacgaaggggtactaggtactttaccgaactacgtaacgtaaaactcgacgggtaccgggtaggacggcgtagggaggtgttggttacggtacttaagttttattagttgactagttacgtaacgttaaacgtttacgacgttcgtttaggttaccgttacggttttaccgggaccgtaacgggggtaccctacggttaccgtacgggtaacctaagtaaacccgg

SEQ ID NO: 105230 - DNA, 639 bp, Homo sapiens
  misc_feature: GYAE6OF01DIHU6.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagacctccactctctctgtccgtccacccctggacagccggcctccatcctcctgcaagtctagtcagagcctcgtgcatagtgataggaaagacctatatgtactggtacctgcagaagtcaggccagcctccacgactcctagtatttatagtaacgttttccaagtcgtttagtttggagtcgccagacgtaggtctcgaggtggcaggtccgggtacgaaggggtactagtactttaccaactaacgtagtaaactcgaacggtccggggtaggacggtcgtaggagggtagttaggttacggtacttaagttttattagtttagtacgtagttacgtaaccttaaaaggtttacctaggttaccgttacggttttaccgtttaaccggtttttcgggacccgggtaaccggggtaacccttaaccggttacccgtacggtaaacctaacgttaacccgtaaaaacccggg

SEQ ID NO: 105231 - DNA, 492 bp, Homo sapiens
  misc_feature: GYAE6OF01BZVRT.29.71.G05.1.454.CMB.1.raw
  modified_base (375)..(375): a, c, t, g, unknown or other
  misc_feature (375)..(375): n is a, c, g, or t
  modified_base (430)..(430): a, c, t, g, unknown or other
  misc_feature (430)..(430): n is a, c, g, or t
  modified_base (477)..(477): a, c, t, g, unknown or other
  misc_feature (477)..(477): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcaccccttgaccagccggcctccatctcctgcaagtctagtcagagcctcgtgcatagtgatggaaanacctatatgtactgtacctgcagaatcaggccagcctccacgactcctgatttangtaatttccaagtcgtttatttggagtgccagcaggctcgagtgganaggcgggtgaacggg

SEQ ID NO: 105232 - DNA, 556 bp, Homo sapiens
  misc_feature: GYAE6OF01A7R2K.29.71.G05.1.454.CMB.1.raw
  modified_base (311)..(311): a, c, t, g, unknown or other
  misc_feature (311)..(311): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaagactatatgtactggtacctgacagagtcaggccagcctcacgtactctgtatttanagtaacgtttccaagtcgtttagtttggagtgcctagacgaggcctgaggtgacgaggcgggtacgaagggactaagtacttacaacgacgtaagaaacgtcgacggccgggtaggaggcgtagggaggtagttggttggtacttagttttacttattagactatagtacgtaaagttacgagtcttagttacttacgtttcggacccgtagggtaccctacgtaccgtacgtactaagtaaccg

SEQ ID NO: 105233 - DNA, 523 bp, Homo sapiens
  misc_feature: GYAE6OF01BK8MJ.29.71.G05.1.454.CMB.1.raw
  modified_base (310)..(310): a, c, t, g, unknown or other
  misc_feature (310)..(310): n is a, c, g, or t
  modified_base (420)..(420): a, c, t, g, unknown or other
  misc_feature (420)..(420): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgatggaaagcctatatgtactggtacctgcagaagtcaggccagcctcacgactcctgtatttangtaacgtttccaaggtcgtttagtttggaagttgccgagacgaggctcgaggtggcgaggcgggtacgagggacagtatttcaacactagaaatcgaggcgggtggaggntggaggtgtggttggctatttattagttgctatgtataagttacagtcttgttctacgtttcggaccgtagggacctacgttccgaggactagtacgtaaacg

SEQ ID NO: 105234 - DNA, 537 bp, Homo sapiens
  misc_feature: GYAE6OF01A1QUA.29.71.G05.1.454.CMB.1.raw
  modified_base (311)..(311): a, c, t, g, unknown or other
  misc_feature (311)..(311): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagagtcaggccagcctccacgactcctgatttangaagtttccaagtcgtttattttgggatgccagacgaggctacaggtggcgaggcgggtcgagggacagtatttcacactagaaatcgaggccgggtggaggcgtggaggtagtggttaggacttacgttttagttatttggactatgtactaaagtttacagtcttagttcttacgttttcggacccgtaaggggtacccagttacccgtcggactacgtaaccg

SEQ ID NO: 105235 - DNA, 752 bp, Homo sapiens
  misc_feature: GYAE6OF01EWRBQ.29.71.G05.1.454.CMB.1.raw
tcagatagagtactcacgaccggtgctcgatttagtgtcgtcgcaagagagagggggactgatcaggacttctcagttcatcttctcaccacgtaggcgtccctcgtctccacgctcctactggggtcgggtcgtcgtaacttagtcgtccttggtacgtaaccttcggagtacctacggtagggaggaattattagtaggactagacccgaacgactccacctactcctctcgtccgtccaccctcgacgacgccggcctacctactactcctcgtcaacgtacgttacgtacacgacgtcctcgtgtcagtagtagagtaggaaacgaacctatataggttacgtcggtacgtcgacgacgaagtacgacgaccgacgtcctacccacgtactcctgttaactttagttacgtaaagtttacctaacggttacgtttacgtttttaggtaacggtcaccgaacgacgtacggtactacgtaggtacgggtacgacgggtaccgggtacggaacgggtacggtaattacgttactaacgtaaacgtaacgtaaacgtacggacgggtcggggtacgggtaagggccggtaggtagggtacgttaggttggttacgttaattttaagtttacgttacgtacgtagttacggtaacgtttaaacgttaacgttacgtcgtttagttacggttacgtttacgggacccgtaacgggtacccggttaccttacgtacggtactacgtaaaacccg

SEQ ID NO: 105236 - DNA, 739 bp, Homo sapiens
  misc_feature: GYAE6OF01ELUXO.29.71.G05.1.454.CMB.1.raw
  modified_base (204)..(204): a, c, t, g, unknown or other
  misc_feature (204)..(204): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggactccagtggagatattgagatcgacccagacctccactctctctcgtccgtccacccgtggacncgccgcctccatctctgacagtctagtcagcgtccgtgtcgactagtagtagaagtaagggaaaactaccttaagttaacgttcgtaacgttcggtaccctgacgtaaggtaacgtcgacggccacgccctaccgacgtaccttcgtagttacttttagtacgttaacgtttaccgaaggtttcgttttaggttggacgtcgtacgagtacgacggtctaggtaggtcggacgagggtccgggtacggaacgggtacgtagttaacgtttaccgaaacgtaacggtaaacgtaaacgttccgggaaccggggtaccggggtaggggtaaccggtcggttaaggggtaagggttaggttttagggttcggttaacgtttttaaagttttaacgttaggttacgtacgtaaggttaacgtaaacggtttaaacgttacgtaacgttccggttttacgttacccggttacggtttaccgggaaccgggttaccggaacccgttacgttaccgaagtaccgtaagtaaacgtaaaccgg

SEQ ID NO: 105237 - DNA, 588 bp, Homo sapiens
  misc_feature: GYAE6OF01ENKN5.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagactatatgtactggtacctgcagaagtcaggccagcctccacgactcctgtatttangtaagtttccaagtcgtttatttggagtgccagacaggctcgagtggacgaggcgggtcgaacgggacagtatttacgaactactagaaaatcgaacggccgggtaggagggctaggaggtagttggttacgggtacttaagttttaagtttagtttcgactagttagtaactaaagttttaacaaggttcgttacggtttaccttaacggtttttcgggacccgtaacgggggtaccctaacgttacccgtagggtaacctagtaaccgtaaaaccg

SEQ ID NO: 105238 - DNA, 664 bp, Homo sapiens
  misc_feature: GYAE6OF01EK2UO.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatcgacccagactccactctctctgtccgtcacccgtggacagccggcctccatcctcctgcaagtctagtcagacgcctcgtgctagtagtagagtaggaaagaccttatatgtacgtggtacctgacaaggaacgtcgacggccacgccctccgaacgtccttccgtagtattttagaggttaacgtttaccgaaggttcgtttaagttttggagttcgacctagacgaggtctacgaggtcggacgtacgggccgggtacgaacggggtactaagggttactttaccgaacgtacgtaagtaaacgtcggacgggtaccggggtaggacggtcgtagggacgggtagttcgggttacggtacgtttaagtttagtttagttagtacgtaagtacggtaacgttaaagtttaccgtagttacgtttcgtttacgttacggttttcggacccgggtaacgggtaaccctacgtaccgttaaggaactaacgtaaccgtaaaacgg

SEQ ID NO: 105239 - DNA, 661 bp, Homo sapiens
  misc_feature: GYAE6OF01B0USV.29.71.G05.1.454.CMB.1.raw
  modified_base (254)..(254): a, c, t, g, unknown or other
  misc_feature (254)..(254): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaanacctatatgtactggtacctgcagaagtcaggccagccctccacgactcctgtattttatagtaagtttccaagtcgtttatttggagtcgaccagacaggctacgaggtggcgaggccggggtacgaagggactaagtactttaccaactaacgtaagaaatccgacgggtccggggtagggacggtcgttagggaagggtagttgggtttacgggtactttaagtttttagttagttacggtactaagttacggtaaaccgttaaaaggttttaccgaaggtttccgtttacggttttacccgttaaccgggttttttaccggggaccccggttaaacgggggtaaccccttaacggttacccggttaagggaacccttaaacgttaacccggtaaaaacccggg

SEQ ID NO: 105240 - DNA, 658 bp, Homo sapiens
  misc_feature: GYAE6OF01AR5B1.29.71.G05.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcaccctggacngccggcctcatctcctgcaagtctagtcagacgcctcgtgcatagtgatggaaacacctatatgtactggtacctgcagaagtcgaggccagtccnccgaacgacctccgtagtatttacgagtaacgtttccaaggtcgtttagttttgggattcgaccgaagacgtaggtactcgaagggttcgggacgacgggtccggggtacgaaggggtaactaggttaactttaccgaactaacgtaagaaacgtcggacggtccgggggtaggacggtcgtagggaggtacgtttagggttcggactttaagttttaattacgttacggactaagttaacgtaacggtttaaaacgtttacgaacggttcctttaggttaacccttacggggttttaccggaccgggtaaacggggttaccccttagtacccggttacggaaaccgttacgtaaaacccggg

SEQ ID NO: 105241 - DNA, 646 bp, Homo sapiens
  misc_feature: GYAE6OF01CMIFT.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagcccggcctccatctcctgcaagtctagtcagagcctcgtgcatagtgagtaggaaaagacctaatatgtactggtacctgacaggaagtcacggccagcctccacgactctgatttatgtaagtttaccaagttcgtttaagttttggagttcgacctaaggaccagggccttacgaggttcgggacgacgggtcgggtacggaacggggtacaaggtactttacgaacgtaacgtaaggtaaaacgtacgaacgggtaccggggtagggaaggtccgtaggaagggtagttaggtttaggtacgtttaacttttagttagtttacgtagtacgtaggtaacttaaagtttaacgtagtaccgttgtttaccgttacggtttttacgggaccggtaacgggaacccgtacgttaaccggtaggaacctagttaaaccgtaaaaccgg

SEQ ID NO: 105242 - DNA, 532 bp, Homo sapiens
  misc_feature: GYAE6OF01CL6FD.29.71.G05.1.454.CMB.1.raw
  modified_base (381)..(381): a, c, t, g, unknown or other
  misc_feature (381)..(381): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctcgtccgtccacccctggacacgcccggcctccatcctcctgcaagtctagtcagacgcctcgtgcatagtgataggaaanacctatatgtactggtacctgacaagagtcaggccagccctaccacgacctcctagtatttatagtaacgtttccaaaggttcgtttagttttgggagttcgaccaggacgaggtcctacgaggtcggacgaggtcgggtagtaaacgggg

SEQ ID NO: 105243 - DNA, 512 bp, Homo sapiens
  misc_feature: GYAE6OF01DAKT2.29.71.G05.1.454.CMB.1.raw
  modified_base (429)..(429): a, c, t, g, unknown or other
  misc_feature (429)..(429): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctgacacgccgcctccatctctgcaagtctagtcagacgcctcgtgctatagtgagtaggaaacgacctatatgtactggtacctgcagaagtcaggccacgcctccacgtcctctntatttatagtacgtttcaagttcgttagtttggagttcgaccagacgacgctacgtaggtggacgacggcgggtcgaacgggg

SEQ ID NO: 105244 - DNA, 720 bp, Homo sapiens
  misc_feature: GYAE6OF01DOIR6.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagacctccactctctctcgtccgtccaccccgtggaccacgcccggcctccactcctcctgcaagtctagtcagacgcctcgtgcatagtgaagtaggaaactacctatagtgtaacgtcggtacctgacaaggaacgtcgacggccacgtccctacccgaaccgtaccttccgttagttaattttaagtacgttaaacgttttaccgtaaaggtttcgttttaagttttagggacggttcgaccgtaacggaacgtacggtcctacggagggtcgggacgtacggggtaccgggtacggaacggggtaacctaggttaacctttacaaccgtaacgtaaggaaaacttcggaacgggtccggggtaggaggtacgtagggtaggttagttgggttacgtatttaagtttttattagttcgaacgttagtacggtaaacgtttaaacgtttacgacgtttcgtttcgtttacgtttaacgggttttccgggacccggtaacggggtaccttacgttacccggttaggaacccttaaaggttaaacccgtaaacgg

SEQ ID NO: 105245 - DNA, 631 bp, Homo sapiens
  misc_feature: GYAE6OF01C7F90.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtccacccctggacagcccggcctccatctcctgcaagtctagtcagacgcctcgtgcatagtgataggaaagacctaatatgtactggtacctgcagaagtcgacggccagcctaccgacgacctcctgtatttatagtaacgtttaccaaggttcgtttagttttggagttgaccgaagactaggtctcgaggtcggacgaggcgggtacgacgggtacagtactttacactactagaaactcgacggtccgggtaggaggtcgtaggaggtagttcggttaggtactttaagttttacttagtttacggactacgttagtaacttaaaaggtttaccgtaagttccgtttacgtttaccgtttacggtttttccgggacccggtaacggggtaaccctaccgttacccggttaggtaaaccgtaacgttaaccgtaaaaccggg

SEQ ID NO: 105246 - DNA, 564 bp, Homo sapiens
  misc_feature: GYAE6OF01D1YJV.29.71.G05.1.454.CMB.1.raw
  modified_base (317)..(317): a, c, t, g, unknown or other
  misc_feature (317)..(317): n is a, c, g, or t
  modified_base (364)..(364): a, c, t, g, unknown or other
  misc_feature (364)..(364): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagacctccactctctctgtcctcaccctgacngccgcctcatctctgcaagtctagtcagcgcctcgtgctagtagtanagtaggaaagtaccttatagtcgtacgtcggtacctgacagaacgtcacggccacgccctacccgacgtacctcctagttactttaagtcggtaacgttttccgaaagttcggttttagttttagggacgttcggacctaaggacgtacgggtccttcgtaacgggttcggaccggacgggtccgggtcggtaaacgggg

SEQ ID NO: 105247 - DNA, 733 bp, Homo sapiens
  misc_feature: GYAE6OF01DI5NX.29.71.G05.1.454.CMB.1.raw
  modified_base (216)..(216): a, c, t, g, unknown or other
  misc_feature (216)..(216): n is a, c, g, or t
tcagatagagtactcacgaccggtgctcgatttagtgtcgtcgcaagagagagggggtcaggctggaactgaggagcaggtgggggcacttctccctctaacactcctcccctgttgaagctctttgtgacgggcgagctcaggccctgagtgggtgacttcgcaggcgtagactttgtgtttctcgtagtctgtctttgctcagcgtcgagggtnctgctgaggctgtaggtgctcgtccttgactaagtcgacttcgtaggacttaccgtggactcgagtggagatattggagtactcgacctagacctacctacgtctacgttccgtacgtccccgtacctacccgtaggactaccggcccggtcctacctacgtcctccgtagtactaacgtcgtaacgtcgacgtacgtccgtcgtcgtactacggtaggtaacgaaggttaaccggaaaactcccttaaatacggttaaccggtacgtttacggtacccgtaacgtagaacggttactccggaacccgggtaacccaccggtaccccctaccggtaaacccttcccgttacggtttaacgtaaacgttttacgttaaacggtttacccgttacggttaaaacggttttcggtttttaaagttaccgggaaccggttaccggaggttaaaccgcggtaccgttaccgttaacgggagtaccgggtacgggtacggggtccgggtaacggtaaacgggg

SEQ ID NO: 105248 - DNA, 607 bp, Homo sapiens
  misc_feature: GYAE6OF01A5PEF.29.71.G05.1.454.CMB.1.raw
  modified_base (372)..(372): a, c, t, g, unknown or other
  misc_feature (372)..(372): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatcgacccagacctccactctctctcgtcccgtccaccccttgacacgcccggcctccatcctcctgactaagtctagtcagacgcctcggtcnctagtacgtgagtagggaaacgtacctattacgtggttaacgttacggtaccctaggacgtaaggacgttacgacggaccaccggtccctacccaacgtacccttccgttagtacttttaacgtacggttaactttaccgtaaggttcgttttagtttacgggacgttcggaccgaggtaccgacggtacctacggacgggttacggaccgacgggtcggggtacggtaacgggg

SEQ ID NO: 105249 - DNA, 559 bp, Homo sapiens
  misc_feature: GYAE6OF01AG94H.29.71.G05.1.454.CMB.1.raw
  modified_base (444)..(444): a, c, t, g, unknown or other
  misc_feature (444)..(444): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacacgcccggcctccatcctcctgcaagtctagtcagagcctcgtgcatagtgatggaaagacctatatgtactggtacctgcagaagtcaggccagcctccacgactcctgtatttatgtaacgtttccaagtcgttagttttggagtgccagacaggtctacaggtggcgaggcgggtacgagggacagtatttcactactaagaaactcgaggccgggtggaggcgtaggaggtagtggttaggtnttaagttttattagttgactatacgtaactaagtttacgagtcgttgttacttacggttttcgggacccgtaaggggaccctagttacccgtagggaacctagtaacgtaaacgg

SEQ ID NO: 105250 - DNA, 552 bp, Homo sapiens
  misc_feature: GYAE6OF01EGTMB.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctcatctcctgcaagtctagtcagagcctcgtgcatagtgatggaaagacctatatgtactggtacctgcagaagtcaggccagccctccacgactcctgtatttatgtaagtttccaagtcgtttagttttggagtgaccagacaggctcgagtggcaggcgggtcagggacagtatttacactactagaaactcgacggtccgggtaggacggcgtaggaggtagttggttggtacttagttttatttagtgtactaagttgacgttaaagtttacagtcgttgtttactcgttttacgggaccgtaacggggtcctacgtcccgtaggtacctagtaaacccg

SEQ ID NO: 105251 - DNA, 639 bp, Homo sapiens
  misc_feature: GYAE6OF01D8VMO.29.71.G05.1.454.CMB.1.raw
  modified_base (215)..(215): a, c, t, g, unknown or other
  misc_feature (215)..(215): n is a, c, g, or t
  modified_base (335)..(335): a, c, t, g, unknown or other
  misc_feature (335)..(335): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgtctttgctcagcgtcgagggtnctgctggaggtctggtaggtgctgtccttgctaatcgctcgtggactccgtggactcgaggtaggagtatatgagatcgaccagacctccactcctctctcgtcctcccacccgtggacncgcccgtcctccactcctctcgactacgtctagcgacgacgtccgtcgcgtactagttaggtagtaagtaacgggtaaactaccttagttaacgtacggttacgtaccggtaaccttggaactaacggtaacgtccgaacccggtccgaccgtaccccttaaccgaccgtaccttccgttaagttaactttacgtaacgttaaccggtttacctaaagggtttcgtttaggtttaggacgttcgacccgttaagacgtcgtaccgacggtaggtcggtaacgcggggtacggtacggtaaacgg

SEQ ID NO: 105252 - DNA, 660 bp, Homo sapiens
  misc_feature: GYAE6OF01CQN6T.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctagtatttatgtaacgtttccaaagtcgtttattttgggagtcgtaccagacaggtctcgaggtggcgaggcgggtacgagggacacgattttaccgaactaacgttagaaaacgtccgaagggtcccggggtagggaacggggtctagggaggtaacgttggggtttacggtacgttaatttttaagtttacgttacggtactaacgtttaggaaccgttaaaaacggttttaccgaacggtaccgtttacggtttaccgtttaaccggtttttaccggggaccccggttaaacggggggtaacccctaaaccggtttccggttaaccgggtaccgttaaacgttaaaaccccgg

SEQ ID NO: 105253 - DNA, 656 bp, Homo sapiens
  misc_feature: GYAE6OF01DVBNN.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtccacccctggacacgccggcctccatctcctgcaagtctagtcagacgcctgtgcatagtgataggaaactactatatgtactggtacctgacagaagtcgagccagccctaccacgacctcctagtatttagagtaacgtttaccaagttcgtttagtttgggagttcgaccaaggacgagggtcctacgaggtggacgacggcgggtacgaagggactaagtactttacaacgtaacgtaagaaacgtcgacgggtccggggtagggacgggtcgtaggaacgggtagttagggtttagggtactttaagtttttagtttaagtttcggtaaccgtagttacggtaaacgttaaaaggtttaaccgtacggttacctttacggtttaccgtttacgggttttacgggaacccggtaacgggggtaccctacgttacccggtaggaacctaagtaaccgtaaaaccggg

SEQ ID NO: 105254 - DNA, 548 bp, Homo sapiens
  misc_feature: GYAE6OF01DRP2H.29.71.G05.1.454.CMB.1.raw
  modified_base (384)..(384): a, c, t, g, unknown or other
  misc_feature (384)..(384): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgaccagactccactctctctgtccgtcacccctggacacgcccggcctccatctcctgcaagtctagtcagacgcctcgtgcatagtgaataggaaagacctatatgtactggtacctgacagaagtcacggccacgcctccacgtactcctgtacttatgtaagtttccaagtcgtttagtttggagtcgccagacaggtcctgaggtgcgaggccgggtanagggacagtactttacaactactagaaactcgaggccgggtaggacggcgtggaggtattggtggtcttatttattagttgatagtagtaactaaagtttacgacgttcttgttacttacgtttcggacgtacgggtactacgttccgtacggactagtaaccg

SEQ ID NO: 105255 - DNA, 583 bp, Homo sapiens
  misc_feature: GYAE6OF01E55MV.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacagccggcctccatctcctgcaagtctagtcagagcctcgtgcatagtgatggaaagacctatatgtactggtacctgcagaagtcaggccagcctccacgactcctgtatttanacgtaacgtttccaagttcgtttatttggagttcgaccagacaggtctcgaggtcggcgaggcgggtacgagggactagtactttacaacgtacgtaagaaactcgacgggtccgggtagggacggtcgtagggaggtagttggttacggtactttagttttagtttagttcgtactagtagtacttaaagtttacgagttacgttcgtttacgtacggtttcggaccgtaacgggtacctacgtaccgtaggacctaacgtacgtaaaccgg

SEQ ID NO: 105256 - DNA, 675 bp, Homo sapiens
  misc_feature: GYAE6OF01AJ2HK.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctcgtccgtcacccctggacacgcccggcctccatcctcctgcaagtctagtcagagccttcgtgcataggtgaagtaggaaacgtacctaatagttagtacgtcggtacctgacgaaggaacgtcgaacggcccacgtccctaccaccgtaccttccttagtaattttatacgttaacgtttaccgaagttcgttttagttttgggagtcgaccgtagacgaggtctcgaggtcgggacgagggtacgggtcgaagggtactaagttactttaccgaactacgtaagaaaacgtccggacgggtccgggtagggacggtcgtaggaagggttcgttgggttacgtacgtttagttttattagtttagacgtaagttcgtaacggtttaaaagtttcgtaacgttcgtttacggttttaccgttaccggtttaccgggaccggttaaccggggtaccttacgttacccggtaacgaacgttaccgttaaaaccgg

SEQ ID NO: 105257 - DNA, 681 bp, Homo sapiens
  misc_feature: GYAE6OF01EBOB2.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagactccactctctctcgtccgtcacccgtggacacgccggcctccattcctcctgactaagtctagtcagacgcctgtgcagtaggtgaagtaggaaaactccttaatagtgtactggtacctggacaagaacgtcacggccagccctaccacgtacttcctagtatttatacgtaacgtttccgaagttcgttttaagtttgggacgttcgaccgaaggacgacggtactcgaaggttcggacgtacgggtccggggtacaaggggtactaagttactttaccgaaacgtacgtaaaggtaaaacgttccggaacgggtccgggggtaggacgggtcgttagggaacgggttagttgggtttacggaacttttaagttttaacgtttacgttgaacttaggtacgtaaacgttaaacggtttcgacgttacgtttcggttaccgtttacggttttcgggacccgtaacggggtaccctacggttcccgtaagaacctaagtaaaccgtaaacgg

SEQ ID NO: 105258 - DNA, 666 bp, Homo sapiens
  misc_feature: GYAE6OF01C8F9X.29.71.G05.1.454.CMB.1.raw
  modified_base (151)..(151): a, c, t, g, unknown or other
  misc_feature (151)..(151): n is a, c, g, or t
tcagatagagtactcacgaccggtgctcgatttagtgtcgtcgcaagagagagggggtgatcaggacttctcagttcatcttctcaccatgaggctccctgctcagctccgtggggctgactaatgctctggatacctggatccagtgganatattgagatcgaccagactccactctctctcgtccgtccacccgtggacacgccgccttaccatcctctgacaacgtctagtcagacgtcctcgtcgactaagtaggtagacgttaagggaaaactaccttaagttacgtacggttaccgttcgggttaaccctggaaccgaaggtaacgtccgaaacggccctaacggccctaccgaacgtaccttcctaagttaatttacgtaggtaactttcgaagttcgtttagtttggaagtcgacctaagacgtacggcttagagggtgacgaggtcgggtacgaagggactacgtatttacaacgtaacgtaagtaaacgtcggaacgggtaccgggtaggacggcgttagggaggtagttcggttagtactttaagtttagttagtagtactagttacgtaacttaagttaccgagttcgttacgttgttacggttacggaccggacggtacctacgttaccgtagtaactaacgtaacgtaaacg

SEQ ID NO: 105259 - DNA, 581 bp, Homo sapiens
  misc_feature: GYAE6OF01DTZ6R.29.71.G05.1.454.CMB.1.raw
  modified_base (314)..(314): a, c, t, g, unknown or other
  misc_feature (314)..(314): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagcccggcctccatctcctgcaagtctagtcagagcctcgtgcatagtgataggaaagacctatatgtactggtacctgcagaagtcaggccagcctccacgactcctagtatttanagtaacgtttaccaagtcgtttaattttgggagttcgccaagacgaggtctacgaggtggcgtaggcgggtcgaagggtacaaggtatttcaactactagaaaatccgaggtccggggtaggacggtcgtaggaggtagtggttggacttagttttattagttgtctagtgtaacttaaagtttacgagtcgtttcgttaccttaggttttcgggaccggtaacggggtacctacgttccgtaggaactacgtaaccgtaaaaccgg

SEQ ID NO: 105260 - DNA, 580 bp, Homo sapiens
  misc_feature: GYAE6OF01BT7KF.29.71.G05.1.454.CMB.1.raw
  modified_base (373)..(373): a, c, t, g, unknown or other
  misc_feature (373)..(373): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcacggccctgatgggtgacttcgcaggcgtagtactttgtgtttctcgtagtctgctttgctcagcgtcagggtgctgctgaggctgtaggtgctgtccttgctaatgctctggactacgtggactccaaggtggaagatattgagatcgaccagacctccactctctcgtcgtcccgtacacccgtggacacgcccgcctccatctctgctaagtctagtcagtacgcctcgngcattaggtagtaagtaggaaacgtacttatagtagtacgtcgtaacctgagaaggtaactcgacggtaccacggccctaccgaacggtactccgtaagttaacttaatacggttaacttacccgaagttaccgtttaaggtttcggagtccggacctaagacgtacgacgttacgaggttcggacgagggtcggtaacggtaaggg

SEQ ID NO: 105261 - DNA, 641 bp, Homo sapiens
  misc_feature: GYAE6OF01E4DT1.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatgacccagactccactctctctcgtccgtccacccctggacacgccggcctccatcctcctgcaagtctagtcagacgcctcgtgcatagtgataggaaagcctatatgtacgtggtacctgacaagacgtcgacggccacgccctaccacgtacctccgtagtatttagtacgtaacgtttaccgaaggttcgttttagttttggacgttcgaccgtagacgtacggctacgagggtcggacgacgggtccgggtacgagggactagtaactttacgaactaacgtaagtaaacgtcggacgggtccggggtagggacggtacggtagggaaggtagttagggttaggtacgtttaattttagttagttcggtactagttagtaacgttaaagttacgtaggttccgttagttaccgttacgtttccgggaccgttacggggtaacctacgtaccgtacggtaaccgtaagtaaacccg

SEQ ID NO: 105262 - DNA, 688 bp, Homo sapiens
  misc_feature: GYAE6OF01AW6KR.29.71.G05.1.454.CMB.1.raw
  modified_base (213)..(213): a, c, t, g, unknown or other
  misc_feature (213)..(213): n is a, c, g, or t
  modified_base (395)..(395): a, c, t, g, unknown or other
  misc_feature (395)..(395): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagacttttgtgtttctcgtagtctgctttgctcagcgtcagggtnctgctgaggctgtaggtgctgtccttgctaatgctcgtggactacctggactccgaggtggagtatagttgagtatcgacccagacctccacttcctctctcgtcccgtccaccccgtggaccacgcccggccttaccgactcctcctcgactaaacggttctagtcaggacgtccgttcgngactattaggtagaacgttaagggaaacgtaccttaagttacgttacggtaaccgttcgggtaacccttggaccgtaaagtaacggttccgaacgggtcccaacggtacccctaccgtaaccggtacctttacccggttagttaacttttaacgtaacggttaaccgttttaccgtaaacggtttaccggtttttaaaggttttccgggaaggttccggaacccgtaaggtaaccgacgggtccttaacggtacgggtggaccgtaacggggtccggggttacgaaaccgggg

SEQ ID NO: 105263 - DNA, 566 bp, Homo sapiens
  misc_feature: GYAE6OF01C1G4Q.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctaatatgtactggtacctgcagaagtcaggccagccctccacgctcctgatttatgtaaagtttccaagtcgtttattttggagtgccagacaggcttcgaggtggcaggcgggtacgaggggacaggtatttacaactacgtagaaactcgacggccggggtggacgggctaggaggagttggttaggacttagttttatttattgtacattaggaacttaaaggtttacagtcgttaggtttacttacgttttacgggaccggtacgggggtaccctaacgtccgtacggtacgtaagtaaacccg

SEQ ID NO: 105264 - DNA, 730 bp, Homo sapiens
  misc_feature: GYAE6OF01C47CV.29.71.G05.1.454.CMB.1.raw
  modified_base (204)..(204): a, c, t, g, unknown or other
  misc_feature (204)..(204): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggataccgtggatccagtggagatattgagatcgacccagacctccactctctctcgtccgtccacccgtggacncgccgcctccatctctgcagtctagcagcgcctcgtgcagtagtagagtaggaaactactatatgtacgtggtacctgacgagacgtcgacggccacgccctaccacgtactcctagttactttagagttaacgtttacaaggttcgtttagtttaggacgttcgactagacgtaggtcctacggaggtggaccggtacggggtccgggtaacgggaacggggtacgtaaacgttacgttttaacccgaaacgttaaacggtaaaacgtaaacgttacccgggaacggggtacccgggggtaggtaaggggttaccgttagggggaagggttttacgtttagggtttacggtaacgttttaaggtttttaagttacgttagggtaacccttaggttacggttaaacgtttaaaacgttcgttaacggttccggtttacgttaccggtttaacggtttccggggaccggttaaccgggtacccttaacggttacggtaaccgtaactaaccgtaaacggtaaaccgg

SEQ ID NO: 105265 - DNA, 623 bp, Homo sapiens
  misc_feature: GYAE6OF01CTEZJ.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatcagtggagatattgagatcgaccagactccactctctctcgtccgtcacccgtggacacgccgcctccatctcctgcaagtctagtcagacgtcctcgtgcatagtgataggaaacgtcctaatatgtactcggtacctgaccaagaacgtcgacggccagccctaccgaacgtaccttcctagtaattttagtagttaaacgtttccaaaggttcgtttagtttggaagtcgaccaagacgtaggtcctagaggtggacgaggcgggtacgagggacagtacttacaacgactaagaaactcggacggccgggtaggacggcgtaggacggtagttgggtacgtacttaagttttacgttagttacggtatagtacggtaattaaacggtttaacgtcgttacgttacgtttacttacggtttacggacccggtaagggtaccctacggttcgtaacggtaactaacttaacggtaaaacgg

SEQ ID NO: 105266 - DNA, 680 bp, Homo sapiens
  misc_feature: GYAE6OF01B1H9V.29.71.G05.1.454.CMB.1.raw
  modified_base (427)..(427): a, c, t, g, unknown or other
  misc_feature (427)..(427): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggactacctggatccagtggagatattgagatcgacccagactccactctctctcgtccgtccacccgtgacacgccggcctcatctctgactagtctagtcagacgtcctcgtgactagtaggtagtaagtacggaaaacgtaccttaatacgtcggtaacgttcggtaacctggaaccgaaggaacgtccgacggcctacgacccctaccgaacgtacttcctagttatttacgtagtaacgtttccgaaggtttcgtttaagtttaggagtcgtaccgagacgaggtcctaacgnggtcggacgacgggcgggtaacgagggtacgtagtacttaccgaactaagtaacgaaagtccggacggggtacgggtaggaacgtcgtaggaacggttagttcggttacgtacgtttaagttttacgttagttacgacgttacgtaacggtaaaccgtttaaagttacgttacgtcgttttacgttacgttacggtttcggaacccggtagggttaccctacgtacggttaagaccttaaggaacctaaacgg

SEQ ID NO: 105267 - DNA, 663 bp, Homo sapiens
  misc_feature: GYAE6OF01CFBDP.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggactccaggtggagatattgagatcgaccagactccactctctctcgtccgtccacccctggaccacgcccggcctccactcctcctgactaacgtctagtcacgtacgtccgttcgtcgactaagttacggtagtaagtaagggtaaaacgtacccttaattacgttacggttaaccgttcgggttaacctggacaaaggtaacgttccgaacgggtaccccaacgtcccctacccgaaccgtacccttaccgttaggttaaacttttacgtacggttaacgttttacccgaaaggtttccggtttttaagttttacggggaacgttccgggaacccaaggtaaccgtacggtccgttacggagggttccggacgaacggggtcggggtaaccggtaaacgggg

SEQ ID NO: 105268 - DNA, 610 bp, Homo sapiens
  misc_feature: GYAE6OF01A4DN3.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtcctgctaatgctctggatacctggatccagtggagatattgagatgacccagactccactctctctgtccgtcacccctggacagcccggcctccatctcctgcaagtctagtcagacgcccgtcgtcgctatacgtgaatagggaaacgtaccctaatagtacggtaacttcggtaaccctgacgaaggtaaacgtcaacgggccctacgcccttacccgaaccgtacctccgttagtaacttttacgtacggttaacgttttacccgaaacggttcgtttttaagttttacgggtacgttcgtacccgtaaggaccgacgggtccttcggtaacggtcgggacgtacgggaccgggggttacggtaaacggggg

SEQ ID NO: 105269 - DNA, 656 bp, Homo sapiens
  misc_feature: GYAE6OF01CKKZD.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatcgacccagacctccacttctctctcgtcccgtccaccccgtggacacgcccggcctccactcctcctagactaagtctagtcaggacgcctcgtgactaagttagtagagtaggaaaacgactaattagtacgtacgtacggtacctgacgaaggaacgtcgaccggccacgccctaccacgtacctccttagtaatttagtagtaacgtttacgaagtttcgtttagtttggacgtcgacgagacgtaggcctagtaggtggacgagggtccgggtcgaagggtactagtaacttacaactaagtaagaaacgtgacgggtcgggtaggagtgtaggaggtgttacggtgtacttaagttttattagtacgtacgagttaacgaacggtttaaacgttacgtacgttcgttttacgtttaccggtttaaccggttttccgggaaccggttacgggtaacctaccgttacgtacggaaaccttacgaacgtaaacg

SEQ ID NO: 105270 - DNA, 600 bp, Homo sapiens
  misc_feature: GYAE6OF01BQB11.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgatggaaacgacctatatgtactggtacctgcagaagtcaggccagccctaccacgacctcctagtatttatgtaacgtttccaaggtcgtttagttttgggagttcggaccaggaccacgggtctcgtagtcgggcaggcgggtacagggactaggtattacactacgtacgtaaactcggacggccggggtaggagggtcgtaggaagggtacgttggttggtacgttagttttagttattcgtatagttcgtaagttaaacgtttacaaggttccgttaggtttcctaacggttttcgggacccgtaaggggtaccctacgtaccgtacgggacctaagtaccgtaaaccgg

SEQ ID NO: 105271 - DNA, 501 bp, Homo sapiens
  misc_feature: GYAE6OF01AZRQ5.29.71.G05.1.454.CMB.1.raw
  modified_base (427)..(427): a, c, t, g, unknown or other
  misc_feature (427)..(427): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacagccggcctcatctctgcaagtctagtcagagcctcgtgcatagtgatggaagacctatatgtactggtacctgcagagtcaggccagcctcacgtactctgtatttangtacgttccagtcgtttatttggagtcgtaccagcaggccttacgaggtcggacaggccggggttcgaacgggg

SEQ ID NO: 105272 - DNA, 551 bp, Homo sapiens
  misc_feature: GYAE6OF01A0KVX.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctgatacctggatccagtggagatattgagatgacccagactccactctctctcgtccgtcaccccgtggacacgcccggcctccatctcctgacaagtctagtcagacgcctcgtgcatagtgagtaggaaagacctatatgtaactggtacctgacgagaacgtcaggccagccctccacgtacctccgtagtacttttaagtcgtaacgtttccaacggttcgttttaacgttttagggtagttcgacccaaggtccgacgggtctcgtaaggtcggtacacgggtcggggtcgtaagggg

SEQ ID NO: 105273 - DNA, 710 bp, Homo sapiens
  misc_feature: GYAE6OF01CYC7U.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagcctccgtggggctgctaatgctctggactacctggactccaggtggagatattgagatcgaccagactccactctctctcgtcccgtccacccgtggaccacggccgcctccatctcctgcaagtctagtcagacgtcctcgtgacagttaggtgaagtagggaaactaccttaattagtgttaacgtcgggtaacccttggaccaaggaaacgtcgaacggccacgccctacaacgtcctcgtgtaatttactagtaacgtttaccgaaagtcgttttagtttcggacgttcgaccctaagacgtacggtctacgaggttgggactacgggccgggtagaacgggtaactacggtactttacgaactacgtaagaaaactcggaacgggtaccgggtagggtacggtacggtagggaagggttaagttcgggtttacggacgttttaagtttacgtttagttacgagttaacgttacgtaaacgttaaacgtttacgaggttaccttaggttttaccgttacggttttacccgggaacccggttaacggggtaaccccttaagttaccccggttacggaaaccgtaacgttaaaaacccgg

SEQ ID NO: 105274 - DNA, 629 bp, Homo sapiens
  misc_feature: GYAE6OF01D1VZK.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaaagtcgtttaatttgggagtgccagacaggctcaggtggcagcgggtcgagggacagtatttcacgactagaaagtcacggccgggttaggacgggctggaacgggtagttacggtttagggtactaagtttttagtttaagttttcggacctagttaggtaaaccgttaaaaaggttttaccgtaacggttacgtttacggttttaccgttaacggttttttccggggaaccccggtaaaccggggggtaacccgttaacgttaccccgttagggaacccttagtaaacccggttaaaaaaccggg

SEQ ID NO: 105275 - DNA, 687 bp, Homo sapiens
  misc_feature: GYAE6OF01A1AS3.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagacctccactctctctgtccgtcaccctgacagccgcctcatctcctgcaagtctagtcagacgcctcgtgcagtacgtgataggaaacgtacctaatatcgtactggtacctgacaaggaacgtcgacgggccacgtccctaccgaccgtacctccgtagtattttacgacgttaacgtttcccgaaagttcgtttaagtttgggacgttcgacctagacgaggtctacgaggtcggacgtacggtccgggtacgacgggtactagtactttaccgaactacgtaagtaaacgtcggaacgggtccgggtaggacggtcgtaggagggttattgggttacgtacgtttaagtttaacgttagttcgtactagttacggtaaaccgttaaacgtttaccgacggtttaccgttacggttttacccgttaaccgggttttaccggggaacccggtaacgggggttaacccttacgttacccggtaaggtaacccgttaaacgtaaacccggttaaaaccggg

SEQ ID NO: 105276 - DNA, 525 bp, Homo sapiens
  misc_feature: GYAE6OF01AWJQW.29.71.G05.1.454.CMB.1.raw
  modified_base (511)..(511): a, c, t, g, unknown or other
  misc_feature (511)..(511): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggataccgtggactccagtggagatattgagatgacccagacctccactctctctgtccgtcacccctgacacgccgcctccatctctgacaagtctagtcagacgcctcgtcgcagtacgtgagtaggaataccttatagtgtacgtggtacctgacagtaagtcgacggccacgccctaccgaccgacccttctagtatttagtacgttacgttaccaaggttcgtttagttgagtcgacgagcaggtctgaggtgacgnggcgggtgaacggg

SEQ ID NO: 105277 - DNA, 662 bp, Homo sapiens
  misc_feature: GYAE6OF01CH920.29.71.G05.1.454.CMB.1.raw
  modified_base (129)..(129): a, c, t, g, unknown or other
  misc_feature (129)..(129): n is a, c, g, or t
  modified_base (221)..(221): a, c, t, g, unknown or other
  misc_feature (221)..(221): n is a, c, g, or t
  modified_base (262)..(262): a, c, t, g, unknown or other
  misc_feature (262)..(262): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
tcagatagagtactcacgaccggtgctcgatttagtgtcgtcgcaagagagagggggtcaggctggaactgaggagcagggtgggggcacttctccctctaacactcctcccctgttgaagctctttgngacgggcgagctcacggccctgagtgggtgacttcgcgaggcgtagtacttttgtgtttctcgtagtctgtctttgctcagcgtcgagggtnctgctgaggctgtagtgctgtctgctatgctcgtgatacgnggatcgagtgagtatgtgagtatcgaccagccacctctctctctcgtcccnccacccgtggacnccgccgtccctcactcctctcactacgtcgtagtcacggacgttccgtcgtacgactagttacggtaggtaaacgtaacgggtaaacttaccttagttacgtacggttaaccgttcgggtaaccctggaacgtaacggtaacgtccgaaaccggtacctaccgaccccgttacccgtaaccggttacccttaccgtttaagttaaacgtttacgttaaacggttacgttaaccgtaacggtttagttttagttaacggcgttaccgacggtaacgtaccgggtagtacccgttaggtacggacggtaagtcggggtaacccggggtcgtaaagggg

SEQ ID NO: 105278 - DNA, 695 bp, Homo sapiens
  misc_feature: GYAE6OF01D88DQ.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctcgtggataccgtggatccgagtggagattattgagatcgacccagacctccactctctctcgtcccgtccacccgtggacacgcccgcctccatcctcctgacaagtctagtcagacgtcctcgtgctatagtgaagtaggaaactactatagtgtactggtactgacgaagagtcgacggccacgccctaccacgtaccttcttagtatttaagtagttaaccgtttacgagttcgtttagtttggacgtcgacgtagacgtaggtctacggtacggtggacgtacggggtccgggtaagacggtaatacgttactaacgaacgtaacgtaagtaaacgtccgggtaacggggtcgggtaagggtacgtacggtaagggtaggttacggtttacggtttacggaactttttaagttttagtttacgtcggtaacttggttaaaaccgggtattttaaaacgtttcggtaacgttctttttaacggtttccgtttaacgggtttaccgggaaccgggttaacgttacccttacgttaaccggtggtaaacctaaacggtaaacccg

SEQ ID NO: 105279 - DNA, 654 bp, Homo sapiens
  misc_feature: GYAE6OF01CPZYR.29.71.G05.1.454.CMB.1.raw
  modified_base (216)..(216): a, c, t, g, unknown or other
  misc_feature (216)..(216): n is a, c, g, or t
tcagatagagtactcacgaccggtgctcgatttagtgtcgtcgcaagagagagggggtcaggctggaactgaggagcaggtgggggcacttctccctctaacactcctcccctgttgaagctctttgtgacgggcgagctcaggccctgatgggtgacttcgcaggcgtagtactttgtgtttctcgtagtctgtctttgctcagcgtcgagggtnctgctggaggcttggtaggtcgtcttggtccttgactaagtgctcgtggaacttaccgtggaatcccaggttggagtaattagttaggagactacgaacccacgtacctccaacctcctctcgtcgtcccgtccaccccgtggacgacgcccggcctccactctccctcgactaacgtcttacgacgagtacgtcctcgtacgactagtaggtacgtaagtaagggaaacgtaaccttagtaacgtagtaaccgttcggtacctggacgtaaggaacgttaccggaacgtacgaccgtccctaaccgtaaccgtaccttccgtaattaacgttacttaacgttaattaaccgagtttacggtttacgttgtacgtcgtaccgtaggactacgggtctaacggtggtacggtacgacgggtccgggtaacggtaacggg

SEQ ID NO: 105280 - DNA, 547 bp, Homo sapiens
  misc_feature: GYAE6OF01DCH38.29.71.G05.1.454.CMB.1.raw
  modified_base (272)..(272): a, c, t, g, unknown or other
  misc_feature (272)..(272): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgctcagcgtcagggtgctgctgaggctgtaggtgctgtccttgctatgctctggactacctggatccaggtgganatatgagatcgaccagacctccactctctctcgtccctccaccccgtgaccacgcccgcctcctatcctcctgacaagtctagtcagcgcctgtgactatagtgataggaaactacctatacgtagttactggtacctgacgagaacgtcgacgccacgtccctaccaccgtactacctagttaactttagtagttaacgtttaccgaaggttcgtttagtttggagtcgacaggacgacggtcttcgaggtcggcgagggtccgggtgaacggg

SEQ ID NO: 105281 - DNA, 651 bp, Homo sapiens
  misc_feature: GYAE6OF01BUBZW.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccgcctcatctcctgacaagtctagtcagacgcctcgtgactagtagtgaagtaggaaaacgtacctaattagtgtacgttggtacctgacgaagaagtcgacggaccacgtcccctaccgaccgtacctccgttagtaattttagacgttaacgtttaccaaggtttacgttttagttttaggagtcgacctaaggacgtaggtcctacggaggtcgggacgagggtccgggacgaagggacctaaggtactttaacaactaacgtaagtaaacgtccggaagggtccggggttaggaacggtcgtagggaacggtagttcgggttaggcttttaagtttagttagtagtactagtgtaaaccgttaaagtttacagttccttaaggtttcgtacggtttagggaccgtaacgggtccctagttccgtaggtacccttaagtaaaccgg

SEQ ID NO: 105282 - DNA, 680 bp, Homo sapiens
  misc_feature: GYAE6OF01CWCQT.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgacagagtcaggccagccctccacgtactcctagtactttatacgtaacgtttaccaaggttcgtttaagttttagggagttacggaccaaggtaccgtacgggtccttacgaacgggtcggccgaacgggtcccggggttacgaacgggggtaactaacggtacttttaccgaaacgtaacgttagaaaacgtccggtaacggggtccggggtagggtacggacgttagggaacgggttagtttacgggtttacgggtactttaagtttttacgttaagtttcggtaaccgttagtacggttaacgttaaaaggtttacctaaggtctttacgggttcttacggtttcgggaccggtaacggggtacctacgttaccggtaggtaactacgtaacgtaaaaccgg

SEQ ID NO: 105283 - DNA, 545 bp, Homo sapiens
  misc_feature: GYAE6OF01BKCDQ.29.71.G05.1.454.CMB.1.raw
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaagtacctatatgtactggtacctgcagaagtcaggccagccctccaacgacctcctgtatttatcgtaagtttccgaaagttcgtttagttttggagttcgaccaggacaggctcaggtggcaggcgggtcgagggacagtattaccgaactacgtagaaaatcgaggtaccgggngggaggtgnggaggtatggttggcttatttagttattgntatgtaataaagttacagtcttgttactacgttttcggacgtacggggacctacgtaccgtggaactagtaaccg

SEQ ID NO: 105284 - DNA, 722 bp, Homo sapiens
  misc_feature: GYAE6OF01BMXIY.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggaagatattgagatcgacccagacctccactctctctcgtccgtccacccgtggaccacgcccggtcctcactcctcctgactaagtcgtagcgaggacgtccgttgtcgactaagtaggtagacgtaaggaaactaccttaatacgttacggttacgttcggtacctaggacgtaaggtaacgtcgaccggacccgacgtaccctaccaacgttaccttccgttaaggttaactttacgttacggttaaacgtttaccgtaacggtttcgttttaagttgggacgttcgaaccaacggtacgacggtacgtacgtagggtcgacgggacggggtccgggtaagacgggtaactaacgttactttaaccgaacgttaagtaaaggtaacgtccgggacggggtaccggggtaagcgggttacgtaggggaagtttggtacggtttacggtattttaaggttttattacgtgaacgttagtaaccggtaattaaacgtcgtagttcgtttacgttcgttacggttcggaccggtaacggtctacgttaccggaagtactaaacgttaacggaaccg

SEQ ID NO: 105285 - DNA, 572 bp, Homo sapiens
  misc_feature: GYAE6OF01BXYZL.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgcagagtcaggccagcctccacgtactcctgtatttatgtaacgtttccaaagtcgtttagttttggagttcgccagacagggctcgagtggcgaggcgggtacgagggacagtatttacactacgtagaaactcgaggccgggtaggaggcgtaggagggtagttcggttggtacgttagttttagttagttgactagtgtaacgtaaagtttacgaggttcgttgtttacttacggttttcgggacccggtacggggtacctacgttaccgtaggacctacgtaccgtaaaaccgg

SEQ ID NO: 105286 - DNA, 686 bp, Homo sapiens
  misc_feature: GYAE6OF01CAFJ5.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcccgtggggctgctaatgctctggactaccgtggactccagtggagatattgagatcgacccagacctccactctctctcgtccgtccaccccgtggaccacggcccggccctccatcctcctgactaagtctagtcagacgcctgtgctatagtgagtaggaaacgtactatatcgtacgtcggtacctgacgaagtacgtcgaggccacgtccctaccacgtacctcctagttatttagtagttaacgtttaccgaagttcgtttagttttcggacgttcgaccgaagtacgacggtcctacgagggtcggacgacgggtccgggtacgaacggggaactaggttactttaccgaacgtaacgtaagaaaacgtcgaacggggtccggggtagggaacggtcgtaagggaggttagttgggttacggtactttaagttttacgttagttagacctaagttacgtaaacgttaaacgtttaccgaggttccgtttagtttaccgtttacgtttaccgggaacccggttacgggtaaccctacgttacccgtaacggtaacctaacgtaaacccgg

SEQ ID NO: 105287 - DNA, 529 bp, Homo sapiens
  misc_feature: GYAE6OF01CIIML.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcaccctggacacgccggcctcatctcctgcaagtctagtcagagcctcgtgcatacgtgagttcggaaagaccttaatagtgtactggtaccctgacaagacgtcgagccagcctccgacgtaccctcctgtatttacgtagtaacgtttccaagtcgtttagtttggagttcgacctagacgacggccttcgacggttggacgacggcgggtcgaacgggg

SEQ ID NO: 105288 - DNA, 695 bp, Homo sapiens
  misc_feature: GYAE6OF01DYMFU.29.71.G05.1.454.CMB.1.raw
  modified_base (339)..(339): a, c, t, g, unknown or other
  misc_feature (339)..(339): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtcaccctggacacgccggcctccatcctcctgcaagtctagtcagacgccgtcgtcgctaatagtgaagttaggaaacgtaccttaatatgtacgttaggtacctgcaaggtacgtcgacggaccacgcctccaacgtcttcctagtatttanacgttaacgttccaaggttcgtttagtttggagtcgaccgtaagacgaggtcctagaggtcggcgaggtcgggtacgagggtactagttacttaccgaacgtaacgtaacgaaacgtccgtaacgggtacccggggtggtacgggtagttaacggtagggtagtttcgggttaggtacttttaacgtttttaagttacgtttacggtaacttacggttaacggtaaaactttaaacgggtttacgtacggtttacgtttacgttttacccgtttaacggttttacccggggaacccgggtaaacgggttaccctacgttaccggaaggtaacctaacgtaaccggtaaaacccggg

SEQ ID NO: 105289 - DNA, 720 bp, Homo sapiens
  misc_feature: GYAE6OF01AQAWP.29.71.G05.1.454.CMB.1.raw
  modified_base (215)..(215): a, c, t, g, unknown or other
  misc_feature (215)..(215): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatcgacccagacctccactctctctcgtccgtccaccctggacacgccgcctccatcncctgcaagtctagtcagacgcctcgtgctagtacgtgaagtaggaaaacgaccttaatacttaggttactggtaaccctggaccaagaacgtacgaccggaccaccgccctacccgaacgtacccttccttaggtaattttacgtacggtaaacgttttacccaaaggtttcgttttacgttttagggacgttccgaccgaaggtaccgaacgggtcctacggtagggtcgggaccgaacgggtccggggtacgaacggggtaactaacgttactttaacgaacgtaaccgtaaagaaacgtcggaacgggtccgggtaggacggtacgtagggacggttaggttcggttaggtacgtttaagttttaacgttagttacgtacgttacgtacgttaacgttaaacgtttacgtacgttacgtttacgttaccggttacgtttacgggacccgtaacggggtacctacggttaccgtacggtaacctaacgtaaccgtaaaaccgg

SEQ ID NO: 105290 - DNA, 541 bp, Homo sapiens
  misc_feature: GYAE6OF01BTKIC.29.71.G05.1.454.CMB.1.raw
  modified_base (324)..(324): a, c, t, g, unknown or other
  misc_feature (324)..(324): n is a, c, g, or t
  modified_base (345)..(345): a, c, t, g, unknown or other
  misc_feature (345)..(345): n is a, c, g, or t
  modified_base (456)..(456): a, c, t, g, unknown or other
  misc_feature (456)..(456): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggactccgagtggagatattgagatgacccagcctccactctctcgtcgcccgtccacccctggacncgcccggcctccactctcctncacgtctacgtcagcgcctcgtcgcatagtgaataggaaagtacctatacgtgttacgttcgtacctgacagaagtcacgccctagccctacgacgctacctagtatttanagttacttaccgtagttcgtttagttgggacgtcgcgaacgctacggtccttacgtacggtcggacgcggtccgggtgtaacggg

SEQ ID NO: 105291 - DNA, 677 bp, Homo sapiens
  misc_feature: GYAE6OF01B2RY3.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggtactaccgtggactccaggtggaagattattgagatcgacccagacctccactctctcgtcgtcccgtccaccccgtggacgacgcccggcctccatcctcctgactaacgtctagtcagacgcctcgtgctagtagtgagtaggaaacacctatagtgtacgtcggtacctggacgaagtagtcgacggaccacgtccctaccgacgtactacctagtattagtacgtaacgtttacgaagttcgtttagtttaggagtcgacctagacgagtcctagaggtcggacgacgggtcgggtacgaagggtactagtaacttacaacgtaacgtaagtaaaacgtcggaacgggtccggggtaggtacggtacgtaagggacggttagtttagggttacggtaactttagttttaacttcgtagtacgtaaggttacgtaaacgtttaaaggttacgcgtttacctttagtttaccgttacggtttaccgggaaccggtaacgggtacctaccggttaaccgacggtaaacctaacgtaaacccgg

SEQ ID NO: 105292 - DNA, 799 bp, Homo sapiens
  misc_feature: GYAE6OF01EXA5F.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctaatatgtactggtacctgacgaagaagtccaggccacggccctaccacgacctcctagtactttatgtaaacgtttccaaggttcgtttaattttgggagtcgaccgtaagacgaagggcctacgaagggtcgggacgtacgggtccggggttacgaacggggtactaaggttaacttttaccgaaaccgtaaccgtaacgggtaaaaacttccggtaaacgggtacccgggggttaggggaacgggtaccgtagggtaacgggtaagtttacgggttacgggttaccgttaaagtttttttaacgttaagtttttaccgggaacgttaacggttaacggttaaacccgtttaaaaaagggtttttaacccgtaaccgggttttaccggttttaacgggtttttaaccccggttttaaacccgggttttttttaccggggggaaaccccggttaaacccgggggggttaacccccttaaccgggtttaaccccggttaaccgggggttaaacccttaaaccggtttaaaaaacccccggg

SEQ ID NO: 105293 - DNA, 580 bp, Homo sapiens
  misc_feature: GYAE6OF01A0YVC.29.71.G05.1.454.CMB.1.raw
  modified_base (315)..(315): a, c, t, g, unknown or other
  misc_feature (315)..(315): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagccctccacgactcctgtatttagngtaacgtttcccaaaggtcgttttaattttgggagttgacccagaccgaggctcgaggtggcaggcggggtcgagggacagtatttacactaacgtagaaaactcgaggccgggtaggaggtcgtggaaggtagttggttaggtacttaagttttaatttagttgtacgtagttgtaacgttaaagtttacagttcgttagtttcctacggtttttcggaccgtacggggtaaccctagttacccgtaggtaacctagtaaaccg

SEQ ID NO: 105294 - DNA, 695 bp, Homo sapiens
  misc_feature: GYAE6OF01CYDMB.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtgggctgactaatgctcgtggactaccgtggatccgaggtggagtatattgagatcgacccagacctccactctctctcgtccgtccaccccgtgaccacgcccggccctccacttcctcctgactagtctacgtcagacgtcctcgtgactagtagtgagtaaggaaactactaattagtacgtacgtcggtacctgacgaaggtacgtcgacggcccacgtcccctaccgaccgtcttccgtagttaactttagacgttaacgtttaccgaaggtttcgttttagtttagggacgttcggaccctaaggacggtacgtccgtacgtagggtcggacgacgggtcgggtacgaagggactaagttacttacaacgtaacgtaagaaacgtcggaacgggtcggggtagacggtcgtagggacggttgtttaggtcggtaacttttagtttagttagttcgactagttacggtaaacctttaaggttaccgtagttacgtttacggttacctttacgggttttacgggaacccgggttacggaccttacggttacgacggtaaacacgtaaaccggtaaaccgg

SEQ ID NO: 105295 - DNA, 805 bp, Homo sapiens
  misc_feature: GYAE6OF01DZQRK.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatcgaccagacctccactctctctcgtcccgtccacccctggacacggcccggccctcctactcctcctcgacaacgttcctagtcgagacgtcctcgtgactaagtaggtacgaagtaggaaaacgtaccttaagttacgttacggttacgtacggttaccgtgtaacgaacggtaacgtaccgacggacccaccggtacccctacccgaacgtacccttaccgttagttaactttacgtacgttaaacgtttaccaaaggtttcgtttaggtttggacgtcgacgaagtaccgtaggtctcggtaggtacggtaccggaggtaccggggtacgaacgggtaacgtaacgtttaccgttaaccgtaaaccgtaaccgtaaaggtaaaaccgtcgggtaaacccggggtccggggtaagggtacgggtacgttagggaacgggttaggtttacggggttaacgtttacgtttaaagtttttaaggttacgttaccggtacgttaacggtaacgttaaaccggtttaaaacgtttaccgttaaggtttcccgtttacggtttaacgtttacccggttttacgggaacccggtaacgggtacccttaggtaacccgggttagtaaaaccgtaccgttaaaacccggg

SEQ ID NO: 105296 - DNA, 574 bp, Homo sapiens
  misc_feature: GYAE6OF01BE2JN.29.71.G05.1.454.CMB.1.raw
  modified_base (313)..(313): a, c, t, g, unknown or other
  misc_feature (313)..(313): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctcatctcctgcaagtctagtcagagcctcgtgcatagtgataggaaagacctatatgtactggtacctgacagaagtcaggccacgcctcacgactcctgatttangtaacgtttccaagtcgtttagttttggagtgccagacaggctcgagtggcgaggcgggtcgagggacagtacttcactacgtagaaatcgaggccgggtaggaggtcgtggaggtagttggttggacttaagttttattagttcgactagttagtacgttaaaacgtttacgacgttcgtttagtttaccttacggttttacgggacccggtaacgggggtaccctacggttacccgtacgggtacgtaagttaaacccg

SEQ ID NO: 105297 - DNA, 670 bp, Homo sapiens
  misc_feature: GYAE6OF01D7A91.29.71.G05.1.454.CMB.1.raw
  modified_base (346)..(346): a, c, t, g, unknown or other
  misc_feature (346)..(346): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtacttttgtgtttctcgtagtctgtctttgctcagcgtcgagggtgctgctgaggtcttggtaggtgtctgttccttaggtacttaatcgtctcgtaggacttaccgtggactccgaaggtggaagtattagttgagtatcgaccagctccactctctctcgtcctacacctgacncgccgcctcactctcagcaacgtctagtcagacgtccgtcgtcacgtagtacgtagaacgttaacgggaaacgtaaccttagttaaacgtcggttaaccgttacggttaaccctaggaaccgtaaaggtaaaccggtcgaaccgggtccaaccgggtccctacccgtaaccgtacccgttaccgttaagtttaacgttttaacgtacggttaaacctttaccggtaaacgtttcgttttagttttagggacgttacgaaccgtaacggtacgaacgggttctacggtacggtacggacggacggggtaccggtaggaaccgggg

SEQ ID NO: 105298 - DNA, 745 bp, Homo sapiens
  misc_feature: GYAE6OF01DGI3E.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatgacccagactccactctctctcgtccgtccaccccgtggaccacgcccggccctccatcctcctgactaagtctagtcgagacgccctcgtgactagtaggtgaagtagggaaactaccttaatagttgtacgtcggtacctggacaaggaacgtcgacggccagcccctaccacgtacctccgtagtatttagacgttaacgtttaccgaaggttcgttttaagttttgggacgtacgacccgtaaggtaccgtaggtacctcggacgggttcgggaccggacggggtaccggggtacgaacgggtaactaagttacgtttaccgaaactaacgtaaacggtaaacgtcgggaaccggggtccggggttaggggacggtacgtagggtaagggtagtttagggttaggtaacctttaaggtttttaagtttagttacggaccttaagttacggttaaacgttaaaggtttaccgtaggtttacccgtttaggttttaaccccggtttacggttttccggggaacccgggttaacggggtacccttacggtacccggtaggtaaacccgtaacgtaaacccgg

SEQ ID NO: 105299 - DNA, 697 bp, Homo sapiens
  misc_feature: GYAE6OF01D32LB.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctgggctgctaatgctctggatacctggatccagtggagatattgagatgacccagactccactctctctcgtccgtccaccccgtggaccacgcccggccctccatcctcctagacaagtctaagtcgagacgtccgtcgtgactagtagtgaagtaggaaacgtacctaattatacgttacgtaggtacctgacgaaggtacgtacaggtcccagccctaccacgtacctccgtagtatttatacgtaacgtttacaaggttcgtttagttttcgggaagttcgaacgaagtaccgaggtctacgaggtcggacgaggcgggtacggaaggtacgtaagtacttacgaacgtaaccgtaagaaaacgtccgaacgggtccggggttaggacggtcgtaggaacggtgttcgggttagtacctttaagttttacttaagttcgacgtaagttacggtaaacgttaaacgtttagtacgttcgtttcggtttaacgttcggttttaaccggacccgggttaaaccggggtaaccttaaaccgggttaccccgttaaaggtaacccgtaaaaccggttaaaacccgg

SEQ ID NO: 105300 - DNA, 586 bp, Homo sapiens
  misc_feature: GYAE6OF01DIBFM.29.71.G05.1.454.CMB.1.raw
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (373)..(373): a, c, t, g, unknown or other
  misc_feature (373)..(373): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtgganatattgagntgaccagacctccactctctctcgtccgtcacccctggacacgccggcctccactctcctgctaagtctagtcagacgcctcgtgcagtaggtnagtaggaaacgacctattagtacgtactcggtacctgacaaggaacgtcgacggccacgtccctacccgaaccgtaccttcccgtagttaacgttttatacggttaagtttcccgaaaggttcgttttaaagttttcgggaggttaccgacccgtaggaaccgtacgggtcttacgaggtacgggactacggggtcggggtacggaaacgggg

SEQ ID NO: 105301 - DNA, 532 bp, Homo sapiens
  misc_feature: GYAE6OF01E1PXA.29.71.G05.1.454.CMB.1.raw
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagagtcaggccagcctccacgactcctgatttangaagtttccaagtcgtttatttggagtgccagacaggctnagtggcagcggtcgagggacagtatttacacactagaaatcgaggccgggtggaggcgtggaggagtggttggactatttaatttagttgtctagtgtactaaagtttacagtcgttagtttacctacgttttcggaccgtagggggaaccctacgttacctggaactagtacgtaaaaccgg

SEQ ID NO: 105302 - DNA, 637 bp, Homo sapiens
  misc_feature: GYAE6OF01BB2U2.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctcgtccgtcacccctggacacgcccggcctccatcctcctgcaagtctagtcagacgcctcgtgctaataggtgagtaggaaagtacctatatgtactggtacctgacagagtcaggccagccctcacgtacctctagtatttatagtaacgtttccgaaagttcgttttaagttttgggagtcgccgaagacgtaggcttacgaggtggacgagggtcgggtacgaagggaacgtagtacttacaacaacgtagtaaaacgtcgacgggtcgggtgggacgggtcgtagggtaggtagttggttacggtactttaagttttaagtttagttagtactagttacggtaacgttaaaggtttacgaggttacgtttaggtttaccgttaccggttttacgggaccggtaacggggtaccctacggttacccgttacggtaaaccgtagtaaacccgg

SEQ ID NO: 105303 - DNA, 754 bp, Homo sapiens
  misc_feature: GYAE6OF01DG8MJ.29.71.G05.1.454.CMB.1.raw
  modified_base (224)..(224): a, c, t, g, unknown or other
  misc_feature (224)..(224): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatcgacccagactccactctctctcgtccgtccaccccgtggacacgcccgcctccatcctccngactaagtctagtcagacgtcctcgtgactagttaggtagaagtaacgggaaaactaccttaattagttcggttaacgttacgggtaccctaggacgtaaggtaacgtcgacggcccaacgcccctacccgaacgtacctccgttagttaatttacgtacgttaacgtttaccaaggttcgttttagtttcggacgtcgaccgtagacgaggtaccttacggaggtcggaccgtacgggcggggtacgaaggggtactaaggtttacgtttaaccaacgttaaccgtaaaggaaaacgttccgggaacggggtccgggggttaggacgggtacgtagggtaacgggttagttggggttacggttactttaaagtttttacgtttaacgttcggacttaaggttacgttaaacgttaaaacggtttcgtacggtttcgtttacggtttaccgtttacgggtttaccgggacccgtaacggggtacccttacggttacccggttaacggtaaacctaacgttaaaacccggg

SEQ ID NO: 105304 - DNA, 559 bp, Homo sapiens
  misc_feature: GYAE6OF01B2ID1.29.71.G05.1.454.CMB.1.raw
  modified_base (213)..(213): a, c, t, g, unknown or other
  misc_feature (213)..(213): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
tcagatagagtactcacgaccggtgctcgatttagtgtcgtcgcaagagagagggggtcaggctggaactgaggagcaggtgggggcgactctccctctaacactctcccctcgttgaagctctttgtgacgggcgagctcaggccctgatgggtgacttcgcaggcgtagactttgtgtttctcgtagtctgctttgctcagcgtcagggtnctgctgaggctgtaggtgctgtccttgctaatgctctggatacctggatccagtggagaatagttgagatcgaccagtacctccactctctctcgtccgtccacccctggacacggcccgcctcatctcctgctaagtctagtcagacncctcgtgctatagtgagtagaaacgtcttaatagtcgtacgtaggtaccngacgaagtaacgcgacggaccacgccctaccaacggtcctacgtagtaattttacagttaacgtttacgaacgttcgtttagtttggagttcgaccgaaggtacgacggtctacgtaggtacggagacgggtcgggacggtaacggg

SEQ ID NO: 105305 - DNA, 549 bp, Homo sapiens
  misc_feature: GYAE6OF01BQDAT.29.71.G05.1.454.CMB.1.raw
  modified_base (375)..(375): a, c, t, g, unknown or other
  misc_feature (375)..(375): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatagttgagatcgaccagactccactctctctcgtccgtcaccccgtggacacgccggcctaccactcctcctgctaacgtctagtcagacgctcgtgctatagngtagtaggaaacgtacctaatagtagtacgtcgtacctgactaaggaatccgagtacccagtcccgtaccacgtactcccgtagttatttagtacgttaacgtttccgaagttcgtttagtttggagtcgaccaagtacgagtctacgtaggtcgacgaggccgggtgaacggg

SEQ ID NO: 105306 - DNA, 636 bp, Homo sapiens
  misc_feature: GYAE6OF01CVG6K.29.71.G05.1.454.CMB.1.raw
  modified_base (267)..(267): a, c, t, g, unknown or other
  misc_feature (267)..(267): n is a, c, g, or t
  modified_base (331)..(331): a, c, t, g, unknown or other
  misc_feature (331)..(331): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccaggtggagatattgagatgacccagacctccactctctctgtccgtccacccctggacacggcccggcctccatcctcctgactaagtctagtcagagtccctcgtgcatagtgataggaaanacctatatgtactggtacctgacaagaagtcgacggccagccctacacgactcctgtatttagngtaacgtttccaaaggtcgttttattttagggagtcgacccgtaggacgtacggcttacgaggttggacgaggtcgggtacgaggacgagtagtttacaacgactaagaaacgtacgacgggtaccgggtaggacggtacgtacgggaggtaagttggttaggtacttagttttaagttacgttggtactaagttacgtaacgttaaacgtttacgtaagtcgtttacgtttaccgtttacggttttaccggaaccgtaacgggggtaccctaacgttcccgtacggtaacgtaacgtaaaccgg

SEQ ID NO: 105307 - DNA, 632 bp, Homo sapiens
  misc_feature: GYAE6OF01BER0L.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtcaccccgtggacacgcccgcctccatctcctgctaagtctagtcagacgcctgtgactatagtgataggaaacgtactatagtgtactcggtacctgacagacgtcgaggccagccctcacgacctctgtaatttagagtaacgttaccaagtcgtttaagtttggagtgccaggactacggctgacgtggcgaggcgggtacgagggacgtaagtacttacaacaacgtaagaaacgtcggacggtcggggtaggacggacgtaggagggtagtggttacggtacgttattttaagttagttacggtacgtattacggtaacgttaaagtttaaccgtaggttacgttcgtttaccgtttaaccggtttcgggaacccggtaacgggggtaaccctaccggttaccgtaacgggtaaccgtaaacttaaccggtaaaacccggg

SEQ ID NO: 105308 - DNA, 621 bp, Homo sapiens
  misc_feature: GYAE6OF01D36E7.29.71.G05.1.454.CMB.1.raw
  modified_base (212)..(212): a, c, t, g, unknown or other
  misc_feature (212)..(212): n is a, c, g, or t
  modified_base (368)..(368): a, c, t, g, unknown or other
  misc_feature (368)..(368): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtccttgctaatgctctggataccgtggatccagtggagatattgagatcgacccagacctccactcctctctgtcccgtccacccctggacacgccgcctccatcctctcgacaagtctagtcagacgtcctcgngacagtacgtgaagtacgggaaactaccgtaatagtacggttaacgtacggtacctaggccgaagtaacgtcgaacggcccacgtccctacccaccggtaccttacccgtagttaacttttagtacggttaacgtttacccgaaggtttaccgtttaggttttacggacggttcgtacccggaacggtaaccgacggggtccctaacggtacgggtacggaccggtaacgggtccggggtacggtaaacgggg

SEQ ID NO: 105309 - DNA, 655 bp, Homo sapiens
  misc_feature: GYAE6OF01CPDIO.29.71.G05.1.454.CMB.1.raw
  modified_base (158)..(158): a, c, t, g, unknown or other
  misc_feature (158)..(158): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
tcagatagagtactcacgaccggtgctcgatttagtgtcgtcgcaagagagagggggtcaggctggaactgaggagcagggtgggggcacttctccctctaaacactctcccctgttgaagcttctttgtgacgggcgagctcaggccctgatgggtnacttcgcaggcgtagacttttgtgtttctcgtagtctgctttgctcagcgtcgagggtnctgctggaggctggtaggtnctgtccttgactaatgctcgtggattaccgtggaactccgaaggtggagtattattggaagatcgacctagacctccactctctctcgtccgtccaccccgtgacacggcccgtcctccatcctcgngacgtaattcgtaagtcgaagaccgtcctcggtanactaagttacggtagtaagtaacggaaaacgtaccttaattaagttacggtacgttacgggtacctaggaccaaaggtaacgtccgaacggcccaaccggtcccctaccgaaccgtccttaccgttagttaatttagtaacgttaaccgtttacctaaacggtttcgtttaaacgtttggacggtaccgaccgtaagtaccgacgggtcctacggtagggtacggtaccggaaaggtccggggtaactaaacgggg

SEQ ID NO: 105310 - DNA, 609 bp, Homo sapiens
  misc_feature: GYAE6OF01DI6K3.29.71.G05.1.454.CMB.1.raw
  modified_base (337)..(337): a, c, t, g, unknown or other
  misc_feature (337)..(337): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgtctttgctcagcgtcgagggtgctgctgaggtctgtaggtgctgtccttgctatgctctggactccgtggactccgagtggagtattagtgagtatacggacccagacctccactctctcgtcgtcccgtccacccgtggaccncggcccgcctccatcctctgactaagtctagtcgagtacgtccgtgtcactagtagtgaagtaagggaaactacttaagtatacgttacgtcggtaacctgaacgaagtacgtccgacggcccacgtcccctaccgaccgtaccttcgtagttatttaacgtacgttacgtttaccgtaagtttcggtttaagtttggacggttacgaccgtaaggaccgtaccggtctacggtacggttcggacgttcggggccgggtaacggtaacgggg

SEQ ID NO: 105311 - DNA, 604 bp, Homo sapiens
  misc_feature: GYAE6OF01EMS29.29.71.G05.1.454.CMB.1.raw
  modified_base (236)..(236): a, c, t, g, unknown or other
  misc_feature (236)..(236): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagatagagtactcacgaccggtgctcgatttagtgtcgtcgcaagagagagggggtcaggctggaactgaggagcagggtgggggcacttctccctctaacactcctcccctgttgaagctctttgtgacgggcgagctcaggccctgatgggtgacttcgcaggcgtagactttgtgtttctcgtagtcttttgctttgctcagcgtcgagggtgctgctgaggtctgtagtnctgtcctgctatgctctggataccgtggactccgagtggagtatagttgagtatcgacccagacctccactctctctcgtcctcacccgtgacacgccgcctcatcncctgactaagtcttancagacgcctcgngactagtagtgtaagtaggaaacgtcctaattacgtagttaccgttacggtacccgtgaactaaggtaacggtccaacggtcccacggtaccctacccgaacgtacccttcgttagttacttttaagacgttaaccgtttaccgaaggtttcgttttaacgtttgggaacgttcgactaacggaccgtacggtctaccgtaggttcggacctagggtcccgggttagaacggg

SEQ ID NO: 105312 - DNA, 614 bp, Homo sapiens
  misc_feature: GYAE6OF01DHUFB.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgctcagcgtcgagggtgctgctggaggctggtaggtgctgtccttgctaatgctctggatacctggatccagtggagatattgagatcgaccagacctccactctctctcgtccgtccacccctggacacgccggcctccatcctcctgactaagtctaagtcagacgtcctcggtcactaagttaggtacgtaggtaacgggtaaaactacccttaagttacgttaacggttaccgtacgggttaaccctggaaccgtaaggtaaacgttccgaacggacccgtacgcccttacccgacgtaccttccgtagttacttttacgaacgttacgttaccctaagttcgtttacgttaggtacgtcgtacgagaccgagtccgtacgtgtcgggaccgagggtcccgggtagaacgggg

SEQ ID NO: 105313 - DNA, 730 bp, Homo sapiens
  misc_feature: GYAE6OF01CLFGC.29.71.G05.1.454.CMB.1.raw
tcagatagagtactcacgaccggtgctcgatttagtgtcgtcgcaagagagagggggactgatcaggacttctcagttcatcttctcaccatgaggcctccctgctcagctccgtggggctgctaatgctcgtggactacctggactccaggtggagattagttgagactcgacccagacctcctactctctcgtcgtcccgtaccacccgtggaccacggcccggtcctcctattcctcccgtgactaacgtcctagtacgacgacgtccctagtcgatagtaggtagaacgtaaggaaactacttaatacgttacggtaaccgttcggtaaccgtgacgaaaggaacgtccgaacggccacgaccctaccgacgtctcttagtattagtacgttaacgttaacctaggtttacgtttaggttacggagtacgtaccgaaagacggtagtcgtacgggacggtcggacggtacgggtacggtaacggacgggtaaactagttaacgttaccgaaacgtaacgtaaacgttaaacggcgggtaacggggtccggggaaggacgggttagaagggtacggttaggttaaggttcgggttaatttaagtttacgttacgtagtactaagtacggttaaacttaacggttactagttcggtttaagttcgttaacggtttacgggaaccggtacggtacctacgttaacggacgtaaacgtacggtaaaaccg

SEQ ID NO: 105314 - DNA, 585 bp, Homo sapiens
  misc_feature: GYAE6OF01A2OT4.29.71.G05.1.454.CMB.1.raw
  modified_base (365)..(365): a, c, t, g, unknown or other
  misc_feature (365)..(365): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgtctttgctcagcgtcgagggtgcgtgcgtgaggctgtaggtgtctgttccttgctaatgtctcgtggataccgtggactccgaggtggaagtatagttagagacgtcgacccacgacctccacttctctctcgtcccgtccacccgtggaccgacgcccgcctccatcctcncgactaacgtcgtagtcgacgacgtccgtgtcgactagtacggtagtaagtagggaaactacctataactgtacgtcggtactgacagacgtcgaacgtccacgcctaccgacgtacctcgtatatttacgagttaacgttacgtaacgttcgttttagttacggacgttcaccgtagacgtacgactcggtagtcggaacgcggaccgggtagaacggg

SEQ ID NO: 105315 - DNA, 681 bp, Homo sapiens
  misc_feature: GYAE6OF01AIRK4.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctcgtccgtcacccctggacagccggcctccatcctcctgacaagtctagtcagacgcctcgtgcatagtagagtaggaaacgactatatgtactggtacctgacaagaagtcacggccacgccctccacgtacctccgtagtacttttagtacgtaacgtttaccaaggttcgttttaagttttgggacgtcgacccgaaggtacgaggtcctcggagggtcgggacgtacgggcggggtacggaacggggaactagtaactttaccgaacctaacgtaacgtaaaacgtcggtaacggggtccgggggtaggaacgggtccgtaagggtaacgggtagttcgggttaggtaccgtttaagtttttaacgttgtttacgtacgtacgttacgtaaccgtttaaaagtttaccgagtttccgttagttttaccgttacggttttcgggaaccggttaacggggtaccttaccggtaccgttaacgacgtaacgtaaacccg

SEQ ID NO: 105316 - DNA, 693 bp, Homo sapiens
  misc_feature: GYAE6OF01B70JJ.29.71.G05.1.454.CMB.1.raw
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (454)..(454): a, c, t, g, unknown or other
  misc_feature (454)..(454): n is a, c, g, or t
tcagatagagtactcacgaccggtgctcgatttagtgtcgtcgcaagagagagggggactgatcaggacttctcagttcatcttctcaccatgaggcctccctgctcagctccgtggggctgctaatgctctggataccgtggatccgaggtggagattattgagatcgacccagactccactctctctcgtcccgtccaccccgtggacacggcccgcctccatcctctgcaagtctagtcagcnccgttcggtnctagtaggtnaagtaggaaacncttagtatgtactggtacctgacgaagaacgtcgacggccagtccccacgactaccttcgtagttatttacgaggttaacctttacgaggttacgttttagtttgggacttcgaactaggtaacgtcggtcctacggagggttaccggcgacgggtcggggtaacgaacggggtanaacgtttacgttaacgaacctaaggttaacgtaaacgtccggaacggggtccgggtaggacggtagtacgggtaaggtgtttacgggttagtactttaagttttaacgttggtacgtactaggttaacgtaacgttaaaacgtttcgtaacgggtctttacggttaacccggtttacggttcgggaaccccgtaacgggtaccttacgggtcccgtaagtaacgtaacgtaaaaccggg

SEQ ID NO: 105317 - DNA, 661 bp, Homo sapiens
  misc_feature: GYAE6OF01AW5OP.29.71.G05.1.454.CMB.1.raw
tcagatagagtactcacgaccggtgctcgatttagtgtcgtcgcaagagagagggggtgatcaggacttctcagttcatcttctcacaatgaggctccctgctcagctccgtggggctgctaatgctctggatacctggatccagtggagatattgagatgacccagactccactctctctcgtccgtccaccccgtgacagcccggcctccatcctcctgcaagtctagtcagacgcctcgtgcatagtgagtaggaaagaccttaatattcgtactggtacctgacaaggaacgtcgacggccacgccctaccaacgtacctcctagtactttagtagtaacgtttaccaaaggttcgtttagtttacggaggttcgaccaagacgtacggtcctacgaggtcggacgtacgggtcgggttacgaagggtacctagtactttacgaacgtactaagaaactcgaacgggccgggtaggacggtacgtaggaacggtaggttaggttacgggtactttaagttttacgttagttacgacttacgtagtaacgttaaagtttacgtaaggttccgtttacgtttaccgttacggttttacgggacccggtaacgggtacccttacggttaccgtagggtaactaacgttaaccgtaaacgg

SEQ ID NO: 105318 - DNA, 635 bp, Homo sapiens
  misc_feature: GYAE6OF01DX36F.29.71.G05.1.454.CMB.1.raw
  modified_base (334)..(334): a, c, t, g, unknown or other
  misc_feature (334)..(334): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagacctccactctctctgtccgtccaccctggacacgcccggcctccatctcctgacaagtctagtcagacgcctacgtgacagttagtgagttaggaaacaccttatagtgtacgtcggtacctgactaaggaagtcgaggccagtccctaccacgactcagtattangtacttcaagttcgttattggatcgaccagacgaggtctgagggtcgcgtagggcgggtacgaacgggactaggtactttcaaccgtaacgtaagtaaacgtcggaacgggaccgggtagggacggtcggtagggtagggtagttaggttagggtactttaagtttagtttacgttcgtactagtacgtaacgttaaagtttaccgtagttacgttacggtttaccttacggttttaccgggaccggttaacgggtaacccgtacgttacccgtaggaactaacgtaaccggtaaaaccgg

SEQ ID NO: 105319 - DNA, 729 bp, Homo sapiens
  misc_feature: GYAE6OF01DCVAH.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagcttctttgtgacgggcgagctcaggccctgatgggtgacttcgcaggcgtagactttgtgtttctcgttagtctgtctttgctcagcgtcgagggtgctgctggaggtctggtaggtcgtctgtccttgactaagtgctcgtggactacgtggactccgagtggagtatagtggagactacgacccagacctccactctctctcgtccgtctacccgtgaccgacgccggtcctacgtactccgtacctgacctaaacgttcgtaacgtccgaacggtaccgtcccggttcggtcgtaccgtaagtttaaggtacggtaaacggtaacggggtaaaaccttaaaccgttaagttacggttacgttaacgggttacggttacccgtagaccgtaacggtacgtacgacgggtaccctaccgggtaccccttaccgaaccggttaccttaccgttacgttaacgtttagtttaacgttaaccgtttaccgtaaacggttttacggttttaacggttttagggtaccggtacggtaaccggtaacggaaccggtacggtaccgttacggtacgggtacggacgggtacggggtcggggtaacggtaaacgggg

SEQ ID NO: 105320 - DNA, 738 bp, Homo sapiens
  misc_feature: GYAE6OF01DKNS1.29.71.G05.1.454.CMB.1.raw
  modified_base (215)..(215): a, c, t, g, unknown or other
  misc_feature (215)..(215): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgtctttgctcagcgtcgagggtnctgcgtgaggtcgtggtaggtgtcgttcgttccttgacttaagtcgtcttcgtacggtaactacccgtggtactccgtaggtaggaagtattagtagagtactacgacccagtacctacctactcgtctcgtccgtcccgtacccaccccgtacggaccgtccggcccgtcctacctacgttcctcccgtagtacgtaacgttcgtaacgtaccgacggtacgtccgtcgtacgacttaagttaggtacggaaagtaacggaaacttaccttaagttacgttaacgttaccgtacggtacctaggacgtaaacgtacggtacgacccggacctaccgtaccctaacccgtaacgtacccttacgttagttaaacgtttacgtaacgtttaaccgtttaccgtaaagggtttttcggttttaaacggttagggacgttaccggtaacccgtaaggtaaccgtaacggtccggttaacgtacggggttacggaccgggtcggggtaacgggtcggtaaaacgggg

SEQ ID NO: 105321 - DNA, 541 bp, Homo sapiens
  misc_feature: GYAE6OF01AWG96.29.71.G05.1.454.CMB.1.raw
  modified_base (313)..(313): a, c, t, g, unknown or other
  misc_feature (313)..(313): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgataggaaagacctatatgtactggtacctgcagaagtcaggccagccctcacgactcctgtatttangtaacgtttccaagtcgtttagtttggagttcgccagacgaggtctagaggtcggcgaggtccgggtacgacgggacagtatttcgaactactagaaactcgacggtccgggtggacgcgtggagtacgtggttacgtactagtttattattgactatgtataagtttacagtacttcgttctacgtttcggaccgtagggacctatacgtagactagtacgtaaacg

SEQ ID NO: 105322 - DNA, 555 bp, Homo sapiens
  misc_feature: GYAE6OF01DFH4J.29.71.G05.1.454.CMB.1.raw
  modified_base (254)..(254): a, c, t, g, unknown or other
  misc_feature (254)..(254): n is a, c, g, or t
tcagatagagtactcacgaccggtgctcgatttagtgtcgtcgcaagagagagggggactgatcaggacttctcagttcatcttctcaccatgaggctccctgctcagcctcctggggctgctaatgctctggatacctggatcagtgagatattgagatgacccagactccactctctctgtccgtcacccctggacacgccggcctccatctcctgcaagtctagtcagagcctgtgcatagtgatggaaanactatatgtactggtacctgacagaacgtcaggccagccctacacgactcctagtatttatgtaatttcaagtcgtttatttggagtcgacagacaggtctcgagtgcgaggcgggtacgagggacagtattacaactacgtaagaaagtcgaaggccggggtggaggtcgtaggagggtatggtttaggacttagttttagttatttgactagtaggtactaaaagtttacagtcgttagtttaccgtacgttttacgggacgaacggggtacctaacgtcgtaacggactagtaaaccg

SEQ ID NO: 105323 - DNA, 735 bp, Homo sapiens
  misc_feature: GYAE6OF01B87TM.29.71.G05.1.454.CMB.1.raw
tcagatagagtactcacgaccggtgctcgatttagtgtcgtcgcaagagagagggggtcaggctggaactgaggagcaggtgggggcacttctcccgtctaacactctcccctgttggaagcttcgtttggtgacgggcgagctcacggccctgatgggtgacttcggcaggcgtagtactttggtgtttctcgtagtctagtctttgctcagcgtcgagggtgcgtggcgtggaggtcgtggtaggtgcgttcgttccttgctaagtgcttcgtggacttaccgtggactacccgaggtggaagtattagttaggagtagtccggaacccacgacctccctacttctcttccgtcgtccccgtcccaccccgtaggaccgaccggccccgtcctcctactccgtcctacggactaagttcgtacgtcgacgacgtccgtacggtcgactaagttacggtaggaaacgtagggaaaacttaccgttaattaacggttacgttaccggttaccggttaccacggtaacgaaacgggtaaccgtacgaccggtacccaccgtaccctacccggaaccgttacccttaccgtttagttaattttaacggtaacggtttaaccggtttacctaaggttttaccggttttaggtttacgggtacgtccggaacgtaacggtccggtacgtacgtaacggtcgggtacggacgggtacgggtccggggtacggtaaacggg

SEQ ID NO: 105324 - DNA, 753 bp, Homo sapiens
  misc_feature: GYAE6OF01DX617.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagacctccactctctctgtccgtcaccctggacacgccggcctccatcctcctgcaagtctagtcagacgcctcgtgctagtagtgagttagggaaacgacctaatagtcgttaccgttcggttaacctgacgtaaggtaaacgtcgaacgggccaacggtcccctaccctaaccggtaccttccctaggtaatttttaacgtaaggttaaacgttttaccccgaaaggttccgttttaagtttttgggaacgttcgaccgtaagacgtagggccttacgaggttcgggaactacggggtaccgggtacgaacggggtaacaacggttaactttaccgaacctaacgttaacggtaaaaacgtccggtaacgggtacccggggttaggggaaccgggtacggttagggaagggttaggttacggggtttacgggtaactttaagtttttacgtttaacgttaggtactaaggttacgtaacgttaaaagttttaccgacgttacgtttcgtttaccgttacggttttaccgggaccggtaaacggggtaccttacggttacgtaggaacctacgtaaccgtaaaacggg

SEQ ID NO: 105325 - DNA, 611 bp, Homo sapiens
  misc_feature: GYAE6OF01CGBWB.29.71.G05.1.454.CMB.1.raw
tcagatagagtactcacgaccggtgctcgatttagtgtcgtcgcaagagagagggggtgatcaggacttctcagttcatcttctcaccatgagctccctgctcagctcctgggctgctaatgctctggatacctggatccagtggagatattgagatcgacccagactccactctctctcgtccgtccacccctggacacgccggcctccatcctcctgacaagtctagtcagacgtcctcgtgctagtagtgagtaggaaacgtaccttaatagtgtacgtcggtaccgtgacgagtaacgtcgacggaccacgccctaccgaccgtacctccgtagtatttagtacgttaacgtttaccgaagttcgtttagtttggacgtcgacgacgacgtacggctcgaggtcggcgaggcggtacgaggactagtacttacgactacgtaagaagtcgagggtccgggtaggacggtcgtaggagtagtggttacgtattagttttattagttcgactagttacgtaacttaagtttacgtacgttcgttcgttacgttacggtttcggaccggtacgggtacctacgtaccgtagaacctagtaaccgtaaacg

SEQ ID NO: 105326 - DNA, 707 bp, Homo sapiens
  misc_feature: GYAE6OF01A4U0A.29.71.G05.1.454.CMB.1.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatcgaccagactccactctctctcgtccgtcacccgtgacngccgcctccatctcngacagtctagtcagacgtcctcgtgacagtagtgagtaggaaacgtaccttatagttacgtacgtcggtacctgacaaggtacgtcgacggccacgccctaccgacgtacctccttagtattttacgtacggttaaacgtttaccgtaaggttcgttttagtttaggaggtttccgaccgaacggtacgtaggtaccgtacgtagggtcggtacgtacgggtccggggtaaggacgggtaaccgtaggttacttacccaacgttaaccgtaaacggtaaacgtaccgggtacgggcccgggggtagggaccgggtcgtagggtaacgggttggttcgggttaaggttactttaagttttaacgtgttaacggtcttaagtacggtaaacttaaacggtttcaacgttcgtttacggttccctttacgggtttaaccggaccgggtaacggtacctaccggttaccgtaaggaaccttaacgtaaccgtaaacgg

SEQ ID NO: 105327 - DNA, 726 bp, Homo sapiens
  misc_feature: GYAE6OF01DLY8L.29.71.G05.1.454.CMB.1.raw
  modified_base (218)..(218): a, c, t, g, unknown or other
  misc_feature (218)..(218): n is a, c, g, or t
  modified_base (523)..(523): a, c, t, g, unknown or other
  misc_feature (523)..(523): n is a, c, g, or t
tcagatagagtactcacgaccggtgctcgatttagtgtcgtcgcaagagagagggggtcaggctggaactgaggagcagggtgggggcacttctcctctaacactctcccctgttgaagctctttgtgacgggcgagctcaggccctgagtgggtgacttcgcaggcgtagtacttttgtgtttctcgtagtctgtctttgctcagcgtcgagggtcncgtgcgtggaggtctggtaggtgtctcgttccttgacttaatcgcttcgtaggtaacttaccgtggtactcgaggtggtaatagttagttcggaagtacgtaccgaacccgtaggtacctaccctacttccttccttccgtcccgttccccgtccccaaccccggtcggaaccgtaccggcccgtaccctacctacttccctccgtagacctaacgtcgtacgtacacggaccgtcctaggtcgactagtagtacgaagttaacgtaaacgtaccttaagttacgtacggtacttaccggtaccnggtaacgtacggtaacgtccgaacggtacctaccggtacccctaccgaaccgttacccgttcgttaagttaacttttaacgtacggtttaaccgttaaccgtaagggttttaccgttttaagttcgggaccggttaccgaccgtaaacggtacgggtacgtagtacggtaggggtacaggaaccgggttcgggaagtaacggg

SEQ ID NO: 105328 - DNA, 594 bp, Homo sapiens
  misc_feature: GYAE6OF01CNEMY.29.71.G05.1.454.CMB.1.raw
  modified_base (493)..(493): a, c, t, g, unknown or other
  misc_feature (493)..(493): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagacctccactctctctcgtccgtccacccctggacacggcccggcctccatcctcctgctaagtctagtcagcgcctcgtgcatagtgataggaaagacctatatgtactggtacctgcaagagtcacggccagccctaccaccgactcctgtatttatagtaagtttaccaagtcgtttagtttggacgtgaccagacaggtctgagtggcgacgggcgggtacgaagggactagtactttaccaactacgtaagaaaactccggagggcccggggtgggacggtcgtagggacggtgttggttggtactttattttattagttnacgtatacgtacttaaaggtttacgagtcgtttacgttacgttacggtttcggaccgggttaacgggcctacgttccggtaacggtactaacgtaaaccgg

SEQ ID NO: 105329 - DNA, 656 bp, Homo sapiens
  misc_feature: GYAE6OF01DKESZ.29.71.G05.1.454.CMB.1.raw
  modified_base (411)..(411): a, c, t, g, unknown or other
  misc_feature (411)..(411): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccaggtggagatattgagatgacccagacctccactctctctcgtcccgtccacccctggacacgcccggcctccatcctcctgactaagtctagtcagcgcctcgtgactagtaggtcgaagttagggaaaactacctaattacgtagtaccgttcgggtaacctggacaaggtaaacgtcgacggccacggccctaccgacgtactcctagtattatagtaacgtttacaagttcgtttagtttggagtcgacagacgaggtctacgngtggcgagggtcggtacggaagggacgaagtacttacgaactaacgtaagtaaacgtcgacgggccgggtagggtacggtacgtagggtaacgtaggttacggttaggttactttaagttttacgttaattcgtacgtagttacgtaaacgtttaaagttcgtagtccgtttagttaccttacggtttgggaaccccggttagggaccctacgttaccgagtaaactacgtaaaccgtaaacggg

SEQ ID NO: 105330 - DNA, 796 bp, Homo sapiens
  misc_feature: GYAE6OF01BU0VU.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatcgacccagactccactctctctcgtccgtccaccccgtggaccacggcccggtcctccgattcctcctgacctaacgttcgtacgtcgaacgtacgtccttcggtagacctaagttaaggtaggtaagtaacgggaaaaacgtacccttaagtaagttacggttaaccggttacgggttaacccctggtaaccgaaagggtaacggtcccgaacggggaccctacggtccccttaccgaacccggtaccttccgtaggttaactttaagtacggttaaacgtttaccgaaggtttcggttttaaggtttcggacggttccgaacgtacggaacgtacggtcctacggtacgggtcggacggacggggtccggtacggaaacggggtcctaagttacgtttacaaccgtaataacgtaaacgtccggaacgggtccggggtaggacggtcgtagggtaggtcgttagggtacgttactttagtttacgtacgttcgtacgtacgttacggtaaacttaaacggttccgtacgtttcgttaccggttttacgtaacgggttttccggggaacccggttaacgggtaacccgttacggtaccgtaacgggtaacctaaagttaaaccccggtaaaacgg

SEQ ID NO: 105331 - DNA, 552 bp, Homo sapiens
  misc_feature: GYAE6OF01B5BG3.29.71.G05.1.454.CMB.1.raw
  modified_base (385)..(385): a, c, t, g, unknown or other
  misc_feature (385)..(385): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggataccgtggactccaggtgagtatattgagatcgaccagactccactctctcgtcgtccgtccaccccgtgaccacggcccgtcctccatctcctgacaacgtctacgtcagacgcctcgtcgtactatagtanaagtaacgaagtacctatagttacgtacgtcgtactagacgaagtaacgtcgacgaccacgcctccaacgtcctcgtagttattactagtacgttacgagttacgtttagtttaggagtcgacgaacgtcgagtctacgtaggtcgtacgcgggtggtcggtaacgg

SEQ ID NO: 105332 - DNA, 745 bp, Homo sapiens
  misc_feature: GYAE6OF01A6Y60.29.71.G05.1.454.CMB.1.raw
tcagatagagtactcacgaccggtgctcgatttagtgtcgtcgcaagagagagggggtgatcaggacttctcagttcatcttctcaccatgagctccctgctcagctccgtggggctgctaatgctctggactacctggactccgagtggagatattgagtatcgacccagacctccatctctctcgtcctcacccgtgacacgccgcctccatctcctgactagtcctagcagacgtcctgtcgctaataggtgaagttagggaaactaccttaatagtacgttaccgttacgggtaccctaggaccaaggtacgtcgacgggtacccacggtccctacccgaacgtaccttacctaggttaactttaagacggtttaacttacccgtaagttcgttttagttttacgggacgttaccgaccgaaggtaccgtacggtacgtacggacggttcggaccggtagggtccggggtaacggacgggtaacgacgtttaacgttaccaacgtaacgtaaaggtaaacgtccgggacgggtaccggggtaggtaaccggtcggtaagggtacggttacggttaaggtaccggttattaagtttttagttatacggtaccttagtacgttaacgtaaaacgttctagttacgtttacccggttatttaaccgggtttcgggaacccgggtaccgggttaaccttaccggtaccgttaagggacccttaaacggtaaccggtaaaaccggg

SEQ ID NO: 105333 - DNA, 872 bp, Homo sapiens
  misc_feature: GYAE6OF01AHFQA.29.71.G05.1.454.CMB.1.raw
  modified_base (208)..(208): a, c, t, g, unknown or other
  misc_feature (208)..(208): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgctctggatacctggactccgaggtggagattattgagatcgacccagacctccactctctctcgtcctcaccccgtggacncggccgcctcattctcctgactaagtctagtcacgacgtcctggtgactagtagtagaagtacggaaactacctagttacgttcgttaaccgtggtaccgtgaaccgaaggtaacggtccgaacggccctaccgcccgtacccaacgtcccgttcgtttaagttaattttacggtaacggtttaaccgttttaccgaaggtttaacggtttttagtttacggggcgtaccgtaccgtaaggtaaccggtaaccggtccttacgggacggggttaccgggacgggtaccggggttaccggggtacgggtaacggggtaacttaaccggtttacgtttaacccggtaaaccgttaaaccggtaaacggtaaaccgggttacccgggaaccgggggttacccgggggttaaggggtacgggtacgggtaacggggtaacgggtttacgggtttaagggtttacgggtttaactttttaaagggttttaatttacgggtagttaccggtaaacgttaaggtaaacgtttaaacggtttacgtaacggtttccggtttaacggttttccggtttaacgggttttaacccgggaaccggggttaccgggttaaacccgttaccggttacccgggtaaacctaaaccgggtttaaaccgtaaaaccccggg

SEQ ID NO: 105334 - DNA, 600 bp, Homo sapiens
  misc_feature: GYAE6OF01D5MDP.29.71.G05.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctggtaggtnctgtcctgctaatgctctggataccgtggatcgaggtggaagtatagttgagatcgaccagactccactctctctacgtccgtccaccccgtggacacgcccggcctccatcctcctgacaacgtctagtcacgacgtcctcgtgacctaagtacgtagtaacgtaaggaaacgtaccttaagttacgtacgttacgttaccggtactacggaaccgtagtaaggtccgacggtacccgacgaccctccgaaccgtaccttccgttaagttacttagtacgttaacgttcccaaggtttccgtttagtttacggtagtacggcaagcgacggtcgtacgtcggtacggagacgggtccgggtgaacggg

SEQ ID NO: 105335 - DNA, 594 bp, Homo sapiens
  misc_feature: GYAE6OF01AOBLI.29.71.G05.1.454.CMB.1.raw
  modified_base (469)..(469): a, c, t, g, unknown or other
  misc_feature (469)..(469): n is a, c, g, or t
  modified_base (530)..(530): a, c, t, g, unknown or other
  misc_feature (530)..(530): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagacctccactctctctgtccgtcacccctggacacgccggcctccatctcctgctaagtctagtcagacgccttcgtgcatagtgataggaaagacctatatgtactggtacctgcagaagtcgacggccagtccctaccaccgtactcgtagtatttatgtaacgtttaccgaagtcgtttagttttcggagttgaccagacgaggtctacgtaggtcgggcgtacggtcgggtacgacgggactagtaactttcgaatacgtagtaaactcgacgggtcgggtggaggtctagggaggtnttacggttggtacgttattttagttagttggactaagtggtaactaaaggtttcgacgttnttcggtttactacgttttccgggaccgacgggtacctacgtacccgtcgggaactacgtaaacg

SEQ ID NO: 105336 - DNA, 676 bp, Homo sapiens
  misc_feature: GYAE6OF01A1CDL.29.71.G05.1.454.CMB.1.raw
  modified_base (154)..(154): a, c, t, g, unknown or other
  misc_feature (154)..(154): n is a, c, g, or t
  modified_base (212)..(212): a, c, t, g, unknown or other
  misc_feature (212)..(212): n is a, c, g, or t
  modified_base (291)..(291): a, c, t, g, unknown or other
  misc_feature (291)..(291): n is a, c, g, or t
tcagatagagtactcacgaccggtgctcgatttagtgtcgtcgcaagagagagggggtcaggctggaactgaggagcaggtgggggcacttctccctctaacactctccctgttgaagctctttgtgacgggcgagctcaggccctgatgggtnacttcgcaggcgtagactttgtgtttctcgtagtctgctttgctcagcgtcgagggtnctgctgaggtctggtaggtgcttcgtccttgacttaagtgtcttcgtggacttaccgtggacttccgaggtcggatatnttggagtacgtacgaacccagtacctccacttctccgtctacgtccctaccacccgtggaccacggcccgtcctacgacttcctcgtcgactaacggttcctaggtcaacgtacgtccgtcggtacacgtaagttacggtgtaacgtacgggtaaactaccgttaagtacgtacggtaacgttacggtaccgtagaactaacggtaacgtcgaacggtcccaacgtccctacccgacgtaccgttaccgtattaacgtttactacggttaacgtttacccgtaaggtttccgtttaggtttacggacgttacggaccgaaggttaccgacggttacctaccggtacggttacgggaaccgtacgggccggggttaaccgaagggg

SEQ ID NO: 105337 - DNA, 757 bp, Homo sapiens
  misc_feature: GYAE6OF01BHVJE.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtccaccccgtggacacgcccggcctccatcctcctgactaagtctagtcagacgtcctcgtgctaagtaggtagaagtagggaaaacgtaccttaattagtacggttacgtacggttaccctaggacgaaggtaacgtcgacggacccgacgtccccgtacccaccggtaccttccgttagttaattttaacgtacggttaacgttttaccgtaaacggttacgttttagttttagggacgtttcgacccgtaaggaacgtacggtaccttacgaagggttcgggacgtacggggtacggggtaccgaagggtacgtaagttacgtttacgaacctaacgtaagtaaacgtaccggacgggtccgggtagggacggttacgtagggtagggtagttaggttacgggtactttaagttttaagttagttaggtacctaagttacgtaaacgtttaaaacgtttaaccgtacggttaccgtttaggtttaccgttaccggttttaccgggacccggttaaccggggtaaccttacccgttaccggttaggaacccgtaacgttaaaacccgg

SEQ ID NO: 105338 - DNA, 791 bp, Homo sapiens
  misc_feature: GYAE6OF01A73PU.29.71.G05.1.454.CMB.1.raw
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagactccactctctctcgtccgtccaccctggacacgcccggcctccatctccngacaagtctagtcagacgcctcgtgactaagtagngagtagggaaaacgtacctaatagtacgtaacgttcgggtaccctgactaaggaacggtccgacggccacgcccctacccgaacgtaccttccctagttaacttttagtaacgtaaacgtttccgaaggtttcgtttagtttagggtaacgtcgaccgtaagtaccgaacgggtcctacggtagggttacggacgtaacgggtccggggtacggaacggggtaacgtaacgttaaccgttttaccaaacggtaacgtaaacggtaaaaccttccgggtaacggggtcccgggggtagggtaacgggtacggtaaggtaagggtaacgttgggttaccggtaatttaacgtttttaagttaacgttcggtaaaccgtagttacgggttaaaccgttaaaacgttttacggaacggtttaccgtttacggtttacccgttttaaccgggttttccggaacccggggtttaaaccggggtaacccgttacgttacccccggtaagggttaaacctaaaccggtaaaccggtaaaaccggg

SEQ ID NO: 105339 - DNA, 634 bp, Homo sapiens
  misc_feature: GYAE6OF01CVA2C.29.71.G05.1.454.CMB.1.raw
  modified_base (202)..(202): a, c, t, g, unknown or other
  misc_feature (202)..(202): n is a, c, g, or t
  modified_base (404)..(404): a, c, t, g, unknown or other
  misc_feature (404)..(404): n is a, c, g, or t
tcagatagagtactcacgaccggtgctcgatttagtgtcgtcgcaagagagagggggactgatcaggacttctcagttcatcttctcaccatgaggcctccctgctcagctcctggggctgctaatgctctggatacctggatccagtggagatattgagatgacccagactccactctctctgtcccgtccacccccgganacgccggcctccatcctcctgcaagtctagtcagacgcctgtcgactagtagtgataggaaaagaccttaatagtgtacgtaggtacctgacaagagtcgacggccagccctaccaacgtactccgtagtacttttagtagtaacgtttccaaaggttcgttttaagttttcgggaagttcgaccgtagacgaaggtcctgnggtacggcgaaggcgggtacgagggacagtactttacaactaacgtagaaacgtcggacggaccggggtggacgggtacgtaggtaaggtagtttaggtggtaacttagtttttattagtttggtaactagttacgtaacgttaaagtttacgagttcgtttacgttacggttacgtttcgggaccgtaacgggtactccgtacggtacgaactacgtaacgtaaaccgg

SEQ ID NO: 105340 - DNA, 510 bp, Homo sapiens
  misc_feature: GYAE6OF01D4BMD.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacagcccggcctccatctcctgcaagtctagtcagacgcctcgtgcatagtgatggaaagaccttatatgtactggtacctgcagagtcaggcagcctccacgactcctgtatttagtagtaacgttccaagtcgttatttggagttcgaccaggacaggtctacgaggtcggacgagggcgggtcgaacgggg

SEQ ID NO: 105341 - DNA, 783 bp, Homo sapiens
  misc_feature: GYAE6OF01BOSM1.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagacctccactctctctcgtcccgtccaccccgtggacacgcccggccctccatcctcctgactaagtctagtcagacgcctcgtgctagtaggtagagtaacggaaaacgtaccttaagtacgttacgttacgttacgggtaccctgaaccgaaggtaacgtccgacggccgacgcccctaccgaaccgtactcctagtatttaacgtacggttaaacgtttccgtaaagtttcgttttaagtttagggacgttcggaacctagggtaaccgtaggtccttacgggtacggtcgggtaaccggtacggggtaccgggtaaccggaacggggtaacgtaacggttaactttaccgaaaccgttaaacgtaaacggtaaaaacgtccggtaacccgggggtaccggggttaggggaacgggtacgggtaagggtaggggttaagttgggtttacggtaccttttaagtttttaacgttagttcggtaactacggttaacgttaaacgttaaacggtttacgacggttcgttttacggtttaccggtttacggtttaaccgggacccggttaacgggtacccttaccgtaccggttaacgtaacgtaccgtaaaaccgg

SEQ ID NO: 105342 - DNA, 754 bp, Homo sapiens
  misc_feature: GYAE6OF01CHH2Y.29.71.G05.1.454.CMB.1.raw
tcagatagagtactcacgaccggtgctcgatttagtgtcgtcgcaagagagaggggggtgatcaggacttctcagttcatcttctcaccatgaggctccctgctcagctccgtggggctgctaatgctctggataccgtggatccgaggtggagatattgagatcgacccagacctccacttctctctcgtccgtccaccccgtggaccacgcccgcctccatcctccgtgactaagtctagtcagacgcctcgtgactataaggtgagtaaggaaaacgtacctaatagttcgtaacgtcggtacctgacgaggtaacgtccgaacggccacgtccctaccgaaccgtacctcctaggttaactttacgtacgttaacgttttaccgaaggtttcgtttttaaggtttacgggacgttcgacccgtaaggaaccgtagggtcctacggtagggtccgggacgacggggtacggggtacggaaggggtacgtaacggttactttaaccgaacctaaacgtaacggtaaaacgtcggtaaccggggtaccgggggttagggaacgggtcgtaagggtaagggtaacgttagggtttacggttaacgttaagtttttaacgttagtttcgtacgtaagttaacggtaacgtttaaacggtttacgtaacgttcgtttacgtttaccgtttacgggttttacggaccgggtaacgggtaccgtcgttaaccgtaggtaactacggtaacgtaaacgg

SEQ ID NO: 105343 - DNA, 912 bp, Homo sapiens
  misc_feature: GYAE6OF01AN6WX.29.71.G05.1.454.CMB.1.raw
  modified_base (188)..(188): a, c, t, g, unknown or other
  misc_feature (188)..(188): n is a, c, g, or t
  modified_base (217)..(217): a, c, t, g, unknown or other
  misc_feature (217)..(217): n is a, c, g, or t
tcagatagagtactcacgaccggtgctcgatttagtgtcgtcgcaagagagagggggactgatcaggacttctcagttcatcttctcaccatgaggcctccctgctcagcctccgtggggctgctaatgctcgtggataccgtggactccgaggtggagtattagttgagatacgacccagacctccnctctctctcgtccgtcccgaccccggacncggcccgcctcctacttcctcctcgaccgtaacgttcgtacgtacgaacggtaccgtcccgttcgtacgacgtaaggttaggtacggtaaacggtaacgggtaaaacgtacctttaagttaacggtttacggttaaccggttaccgggttaaccgtcggaaaccggtaaaggggttaaaccggtaccggacccgggaccctaacccggtccccgtaacccgtaaccgttacctttaccgttaagtttaacgttttaacggttacggttaaaccgtttaacggtaacggtttcggtttttaaggttacggacggttaccgacgtaacggtacgtaccggttaccgtacgggtaacgggtcggtacgggtacggggttacccggggtaacggaacgggttaacgtacgtttaaccctttaacgaaacgtaaacgttaaacggtaaaccgggtcccgggtaacggggggtccgggtaagggtaccggttaggtaacggggtaggttttcggtttcggtaaacgggtttacttttaaaggttttgtaaacgtcggttaaagtacgtttaagggtaaacccgttttaggttacccgtggtttacggtttaccggttaacccgtttagggttacccgggaccgggttaaacccggttctaccgggttaaccgtaggaaacttaccgttaaaccgggtaacg

SEQ ID NO: 105344 - DNA, 637 bp, Homo sapiens
  misc_feature: GYAE6OF01E0VUR.29.71.G05.1.454.CMB.1.raw
  modified_base (213)..(213): a, c, t, g, unknown or other
  misc_feature (213)..(213): n is a, c, g, or t
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
tcagatagagtactcacgaccggtgctcgatttagtgtcgtcgcaagagagagggggtcaggctggaactgaggagcaggtgggggcacttctccctctaacactctccctgttgaagctctttgtgacgggcgagctcaggccctgatgggtgacttcgcaggcgtagactttgtgtttctcgtagtctgtctttgctcagcgtcgagggtnctgctgaggtctgtaggtgctgtcctgctaatgctctgatacctggactccgaggtggatatattgagntcgacccagacctccactctctctcgtccgtccacccgtgaccncggcccgcctcactcctctgctaagtctagtcagacgtcctcgtnactatagtgaagtaggaaactacctaatagttacgtacgttacggtacctgacgtaaggtacgtacgacggcctaccgccctaccaaccggtaccttccgttagttaacttttacgtaacggtttaaccgtttaaccgtaagggtttccggttttaaacgtttggggtaaccgttacggtaacccgtaaacggtaccggtacggtccgttaccgggaacggttccgggaaccggttacggggtcccggggtaacggtaaacggggg

SEQ ID NO: 105345 - DNA, 786 bp, Homo sapiens
  misc_feature: GYAE6OF01EY8CB.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtccaccccgtggacacgcccggcctccatcctacctgactaagtctagtcagacgtcctcgtgcaagtaggtagaagttagggaaaacgtaccttaattacgtcgtaacgttcgggttaacctggtaccgaaggtaaccgtcgaacgggtcccaacggtccctacccgacgtaccttccgttaggtaattttaacgaggttaaaccgttttaccgaaaggtttccggttttaagttttcgggaacgttaccggacccgtaaaggtaaccggtacggtccttacggtaagggttcgggaccgtaggggtacccggggttaggaacgggggactaacggttactttacccgaacgtaacgttaaagaaacgttcggaaccggggtccggggttaagggacggttcggtaagggtaagggtacgtttcgggttaacgggtactttaagttttaacgttttagttacggtactaacggtttacggtaacgttttaaaagttttaccgagttttacccgtttacgtttaccggtttacgtttacggggacccggtaagggttaccctaacgttcgtaaggaccttaaacgtaacccggtaaaacg

SEQ ID NO: 105346 - DNA, 725 bp, Homo sapiens
  misc_feature: GYAE6OF01BD392.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatcgacccagactccactctctctcgtcccgtcacccctggacacggcccggcctcactcctcctgactaagtctagtcagcgcctgtgactagtagtagaagtaggaaacgtacctattattacgtacttacggtacctgacgaaggaacgtcgacggcccacgtcccctacccgacgtaccttacctagttaactttagtaacgttaacgttaccgaaggtttcggttttaagttttggacgttacggaccgtaaagaccgtacggtctacggtaggtcgggcgacggggttaccgggtaggaacggggaacttaacggttactttaacccaaacgttaacgtaaaggtaaaaccgtcgggacgggtaccgggggtaggaacgggtcgtaagggtaggtaggtttagggttcggttaattttaagttttaggtttacgttaggtactaaggttacgttaaacgtttaaaacgtttccgtagttccgtttcgtttaaccggttacggtttacgggaaccggttaacgggtaccctacgttaccggtacgtaacacgttaaacgg

SEQ ID NO: 105347 - DNA, 772 bp, Homo sapiens
  misc_feature: GYAE6OF01DSU6G.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctcgtggatacctggatccagtggagatattgagatgacccagactccactctctctgtccgtccaccctggacacgcccgcctcatcctcctgcaagtctagtcagacgccttcgtgactagtaggtagaagtaggaaaacgtaccttaatagttagtaccgttggtaaccctgaacaaggaacgtcgaacggccagccctacaacgtactcctagtactttacagttaacgtttaccgaagttacgtttagtttagggacgttacgaccgtaacggacgtacgggtcccttacggtaagggttacggaccggtaacggggtacccggggttaaccggaaacggggtaaccgtaaacgggttaacttttacccgaaaccgttaaaccggttaaacggtaaaaaacgttcccgggaaaccggggtaccccggggttaggggaaccgggttacgttagggtaaacgggtttagtttacgggtttacggtaaccgtttaaagtttttaacgtttacgttagtaaccgttagtacggtaaacgttaaagtttaccgtagttacgtttacggttacgtttaacggtttcgggaaccggtacggtaaccgttacgttaccggtagtaacgtaaccgtaacggttaaaaccgg

SEQ ID NO: 105348 - DNA, 600 bp, Homo sapiens
  misc_feature: GYAE6OF01BTOBO.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaacgacctatatgtactggtacctgacagagtcaggccagccctcaccgactcctgtaatttatgtaacgtttaccaagtcgtttagttttcggagtgaccagacgaggctcgagtcggcgtaggcgggtcgaagggacagtacttcaacgtactagtaaacgtcgacggtccggggtaggacgggtcgtaggaaggtagttaggttcggacttacgttttaatttagttcgtacgtagtacgtaacgttaaacggtttaaccgtaggtactttaggtttacgttaccgtttttcgggaacccgtacggggtacctaacgttcccgtaacggacgtaacgtaaaccg

SEQ ID NO: 105349 - DNA, 596 bp, Homo sapiens
  misc_feature: GYAE6OF01BIOT1.29.71.G05.1.454.CMB.1.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
  modified_base (455)..(455): a, c, t, g, unknown or other
  misc_feature (455)..(455): n is a, c, g, or t
  modified_base (483)..(483): a, c, t, g, unknown or other
  misc_feature (483)..(483): n is a, c, g, or t
  modified_base (498)..(498): a, c, t, g, unknown or other
  misc_feature (498)..(498): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagacctccactctctctcgtccgtccacccgtggacacgcccggcctccactcctcctgacaagtctagtcagacgcctgtnctatagtgaagtaggaaacgtacctatatgtactggtaccngacagagtcaggccacgccctacacgtactctagtatttagtagtaacgtttacgaagttcgtttagttaggtacgtcgaccgagacgaggtctagacggtggacgacgggcgggtacgacgggacagttacttactacaactaagtaaacgtcggacgggtcgggngggacgcgtaggaggtagttggtaggtnttagtttattagttnacgtagtcgtaacgttaaagttactagtcttcggtttacttcggtttcgggaccgtaacggggaccttacgtcggtagactaaacgtcgtaaaaccgg

SEQ ID NO: 105350 - DNA, 807 bp, Homo sapiens
  misc_feature: GYAE6OF01EJ40U.29.71.G05.1.454.CMB.1.raw
tcagatagagtactcacgaccggtgctcgatttagtgtcgtcgcaagagagaggggggtgatcaggacttctcagttcatcttctcaccatgaggctccctgctcagctccgtggggctgctaatgctctggatacctggatccagtggagattattgagatcgacccagacctccactctctctcgtcccgtccaccccgtggaccacggcccggtccctcccacttccttccgtgtacctaagtccgtacgtcagacgccgttcgtcgactagttaggtgaagtaagggaaaacgtaccttaattagttacgttaaccgttcgggttaaccgtggtaccgaaggtaacggtcgaccgggacccacgtccccttaccgaccgtaccttccttagttaacttttagtacggttaaaccgtttaccgaaaggtttacgtttttaggtttagggacgttccggtaaccgaacggtaccgtacggtaccgttacggtaggtcgggaccgtagggggtccgggtaacggtacgggacttaaccgttacgttaaccaaaccggtacgtaaaaggtaaactccggggtacggggtacccggggtagggtacggtccgttaagggacgggttacgttgggtttacgggttaacttttaaggtttttaacgtttgttacgacgtttaagtaacgggttaaacctttaaaacggttttcgtaacgtttcgtttacggtttaccgtttaacgggtttccgggaacccgtacgggttaccctcgttcggtaaagaaccttacgtaaaccggtaacggg

SEQ ID NO: 105351 - DNA, 802 bp, Homo sapiens
  misc_feature: GYAE6OF01CLBDD.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccgagtggagatattgagatgacccagactccactctctctgtccgtcacccctggacagccggcctccatcctcctagcaagtctagtcagacgcctcgtgcagtagtgattaggaaacgtacctatatgtaacgtggtaacctgaccaagtaacgtccgaaggcccgtaagcccttaccgaacggtaccttcccgtagtaacttttaacgtcggttaaacgttttcccgaaaaggttacccggtttttaagtttttacgggacggtttcggaaccctaagggtacgtaaacggggtccttaccggtaagggttcgggacgtaacgggtccgggggttacgaacggggtaactaggtaacgttttaccgaaccttaaacgtaacggtaaaagtccggaagggtacccggggtaggagggtaaccgtagggaacgggttaacggtttgggtttaacggtaccgtttaaagtttttaacgtttaagttacggtaccgttagttaacggtaaccgtttaaaaaggtttaccgtaagttccgtttaacccggtttcgttttaaacccggtttttcggggaaccccgggttaaacggggtaaccccgttaacgttaaccccgggttaccgggtaaacttaaccgtaaacccggtaaaaaacccggg

SEQ ID NO: 105352 - DNA, 630 bp, Homo sapiens
  misc_feature: GYAE6OF01A1MBJ.29.71.G05.1.454.CMB.1.raw
  modified_base (391)..(391): a, c, t, g, unknown or other
  misc_feature (391)..(391): n is a, c, g, or t
  modified_base (610)..(610): a, c, t, g, unknown or other
  misc_feature (610)..(610): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgctcagcgtcaggttgctgctggaggtctgtaggtgctgtccttgctaatgctcgtggactaccgtggactccgaggtggagattagttgagtactcgacccagtacctccactctctcgtcgtcctccgacccgtggacacggcccgtcctccgactcctcctgactaacgtctagacacgacgtcctcggtnacgtagtacggtagtaacgtaagggaaacttacttattaagttacggttacgtcggtaccgtgacgaacggtaagtccgaacggcccacgtcccgacctaaccgtaccttccgttaagttactttagtaacggttaaccgtttaccgaggtttacgttttaggtttacgggacgttcgtaacccgtaggtaccgacggtctacggtaggacgggaccgngggtccgggtggtaaacggg

SEQ ID NO: 105353 - DNA, 751 bp, Homo sapiens
  misc_feature: GYAE6OF01DLL6A.29.71.G05.1.454.CMB.1.raw
tcagatagagtactcacgaccggtgctcgatttagtgtcgtcgcaagagagagggggactgatcaggacttctcagttcatcttctcaccatgaggcctccctgctcagctccgtggggctgctaatgctctggataccgtggactccgaggtggagatattgagtatcgacccagacctccactcctctcgtcgtccgtccacccgtggacacggcccgcctccattcctccgtgacaagtctacgtcgagcgtccgtgtgactagttagagtaagtaaggaaacgtacttagtacgttcgtacgtcggtacctggaacaaggtaacgtccgacgacccaccgtccctacccgaacgttacctcgttagttaacgttttaacgtacggtttaaacctttaccgtaaggtttacggtttttaaggtttcggacgtaccggtaccgaaggtaccggtacggtccttagggaaggtcggacgaacggggtcggtaacggacggaaccttaggttaccttaaccgaactaaagtaacggtaaacgtcgggaccgggtggggttacggacggttgtaagggaagtttcggttacgggttcgggttaacttttaagttttaacgttgtacggtaccgttaggttaaccgtaaacgtttaaacggttcgtacggtttccgtttcgggttaccgttaccgggtttacgggaccgttaccgggttactacggtaccgaagtaacctaacggtaaacccg

SEQ ID NO: 105354 - DNA, 622 bp, Homo sapiens
  misc_feature: GYAE6OF01B6SDX.29.71.G05.1.454.CMB.1.raw
  modified_base (166)..(166): a, c, t, g, unknown or other
  misc_feature (166)..(166): n is a, c, g, or t
  modified_base (354)..(354): a, c, t, g, unknown or other
  misc_feature (354)..(354): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatatgagatgacccanactccactctctctcgtccgtccacccctggacacgccgcctccatctcctgacaagtctaggtcagacgcctacgtgactataggtagaagtaggaaaacgtaccttaatagtacgttacgtcggtacctagacgaaggtaacgtaccgacggccacgccctaccgacgtacctctagtacttttanagtacgtttacgaagttcgtttagtttgagtgaccagactaggcctgaggtcggacgacgggtcggacgaaggacctaggtacttaccgaagtactaaggtaaacgtcggacgggtccggggtaggtccggtagtaaggaggttagttagggtagtacgtttaatttaagttactgtacgtattacgtaacttaaagttccgtagtcgttcgttatacggtttcgaccggtacgggtactacgtcgtaagacctaagtccgaaaacgg

SEQ ID NO: 105355 - DNA, 724 bp, Homo sapiens
  misc_feature: GYAE6OF01C96PU.29.71.G05.1.454.CMB.1.raw
tcagatagagtactcacgaccggtgctcgatttagtgtcgtcgcaagagagagggggactgatcaggacttctcagttcatcttctcaccatgaggcctccctgctcagctccgtgggctgctaatgctctggataccgtggatccagtggagatattgagatcgacccagacctccactctctctcgtccgccaccctggacacgcccggcctccatcgtcctgactaagtctagtcagacgtcctcggtgactaagtaggtagaagtaacggaaaacgtaccttagtagttacgtaaccgtggtaacctgacgaagtacgtcgacgggacccacgtacccctcccgaaccgtaccttccgtaagttaattttagaacgttaacgtttcgaaacggttgttttaaggtttggacgttcgaccgtaagaccgtaggtcctaggcggtggacgtacgggcgggtacggacggaactagtactttacgaactaacgtaacgaaacgtaccggaacgggtccggggtagggacgggtacggttagggaacgggttaggttacgggttacggtaacgttttaagtttaagttttacgttacgtacgtaacgtacggttaaacgtaaacgtttaacgtacggttacgtttacggtttacgttacccggttttaggggaacccgtaccgggtacctacgttaccgtacggtaaccgtaacgtaaacccgg

SEQ ID NO: 105356 - DNA, 760 bp, Homo sapiens
  misc_feature: GYAE6OF01BHCAQ.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatcgaccagacctccacttctctctcgtcccgtccacccgtggacacggcccggcctccatcctcctgactaagtctagtcagacgcctcgtgactagttacggtagagtaaggaaacgtaccttaattacgttacgttacgttacggttaccgtaggaccgtaaggtaacggttacggaaccgggtaccctacggtcccctacccgtaaccggtacccttccgttaagttaacgttttacgacggtttaaaccgtttaccgtaaacggtttacggtttttaagtttcggggacggttaccggaccgtaacggacggtacggtcctacggtagggttcgggacggtacggggtaccggggtacggtaagggaaccgttaaggttaccgtttaaccgaacgtaacgttaaacgaaacgttcggaacggggttccggggtagggacgggtaccggtaagggtaacggtcggtttacgggttacgtacgtttaaagtttttagtacgttacgtacgtagtacggtaaacgtttaacgttgaccgtttgtcgtttagttacggttacggacgtacggactacgtcgtaagacctacgtaagtaacg

SEQ ID NO: 105357 - DNA, 752 bp, Homo sapiens
  misc_feature: GYAE6OF01A5G64.29.71.G05.1.454.CMB.1.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
tcagatagagtactcacgaccggtgctcgatttagtgtcgtcgcaagagagagggggactgatcaggacttctcagttcatcttctcaccatgaggctccctgctcagctcctgggctgctaatgctctggatacctggatccagtggagatattgagatgacccagactccactctctctcgtccgccaccctggacacgcccgcctcatcctctncaagtctagtcagcncctcgtagcagtagtgaactaggaaaacgtaccttagtacttacggtacgttacgggtaccctaggacgtaaaggtaacggtcgaacgggaccacggtccctaccgaacgtcctaccggttataactttacgtagttaacgtttacctaaggttcgtttaagtttcgggagttacgaccgtaagacgtacggtctcggtaacggtcggcgtacgggcgggtacgaacgggtactaaggttacttacgaaacgtaacgtaagtaaaccgtcggtacggggccgggttaagggacgttacggtagggaacgggttgttacgggtttaacgtacgttttaaagtttttaggtacgtttacggtataaccgttagggttaaacttttaaacccgttacggttaacgtacgtttttacgggtttaaccgtttaacgggtttttacccgggaccgggttaaaccgggggttaccctttaccggttaacccggggttacgtaaacccgtaaacggttaaaaccccgg

SEQ ID NO: 105358 - DNA, 743 bp, Homo sapiens
  misc_feature: GYAE6OF01EUKGD.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacagccgctccatctctgcaagtctagtcagagcctcgtgcagtagtgaataggaaaagaccttaatattgtaactcgggttaacctggaccgaaggaaacgtcgaacgggcccaacggtccctacccgaacgtaaccttcctagtactttttaagacgttaaacgttttaccgaaagttcggtttaagttttagggaagttcggaccaaggaccgaacggtctacgaagggtcggcgacggtcgggacgtaagggacgagtagtttaccgaacgtactaaacgaaataccgaaggtccgggtacgggtaggtacgtaggagggtaagttacggtttaggtaccgtttaagtttttaacgtttaagtttacgtacgtacgttacggtaaacgttaaaacggttttaaaccgtaacggtttacccgtttaggttttaacccgttaaccggttttttaccggggtaaccccgggtaaccggggttaaacccgttaacccggttacccgttaacgggtaaccgttaaacgtaaacccggttaaaaaacccgg

SEQ ID NO: 105359 - DNA, 817 bp, Homo sapiens
  misc_feature: GYAE6OF01DL8LT.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgagtgggtgacttcgcaggcgtagtactttgtgtttctcgtagtctgtctttgctcagcgtcgagggtgctgctggaggctggtaggtgctcgtccttgactaatgcttcgtggtacttaccgtggtactaccgaggtaggaagtaattagttggaagtacgtacgaaccctagtacccttacccacttcctccttcgtcgtaccccgtcccaccccgtggaaccacggtcccggcccttccacttcccttcccgtacgtaccgtaacgttccgtaacgtacgaacggtaccgtcccgttcggttacgaccgttaagttacggttaaggtaaacggttaaacgggtaaaaacgttaaccctttaaagttaacgtttacggtttaaaccggtttaccgggttaacccgttacggtaaaccgtaaagggtaaaccggttacccggaaaccgggtacccctaaccggttacccccgttaccccgtaaacccggttaccctttacccggtttaaggtttaaaccttttttaacggtaaccggtttaaccgttttaaccccgtaaaggttttaccgttttaaggtttacgggtaacggttaccggaacccgtaagtacccggtacggtacctacggtagggtaccggacgtacggggtaccgggtggtaaacggg

SEQ ID NO: 105360 - DNA, 737 bp, Homo sapiens
  misc_feature: GYAE6OF01CL3HB.29.71.G05.1.454.CMB.1.raw
  modified_base (208)..(208): a, c, t, g, unknown or other
  misc_feature (208)..(208): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggactaccgtggactccaggtggagattattgagatcgacccagactccactctctctcgtccgtccacccgtggacncgccgtcctcatcctcctgactagtctagtcagcgccgttcgtgactagtagtaggaagtaagggaaaacgtaccttaagttatacgtacgttggtactcgtgacgtaaggacgtcgacggacctacgccaccacgtctctagtatttagtagtaacgtttacaaggttcgttttaagttggactcgacaagacgagtcgtacggaggtcggacgtacggggtccgggtacggaaacgggtaactagttaacgtttaccgaacgtaacgttaaacggaaaacgttccgggaacggggttaccgggggttaggaccggtacggttaaggggtacgttacggtttacgggttaaccgttaacgttttaaacgtttttaacgtttagttacgtacgtaagttaacgtaaacggtttaaaccgtttcgtaacggtttccgttacggttttaccgttaaccgggttttaccgggaaccccggggtacggttaaccccttagggtttaccccgtaacgggtaaacctaaacccgg

SEQ ID NO: 105361 - DNA, 676 bp, Homo sapiens
  misc_feature: GYAE6OF01DPLZ6.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgaccagactccactctctctcgtccgtccacccctggacacgcccggcctccactcctcctgcaagtctagtcagacgcctcgtgacatagtgagtaggaaagacctatatgtactgtactgacagaagtcagccacgcctaccaccgtactcctagtaatttagtagtacgtttaccgaagttacgtttagttttggagttcgaccgtaagacgacgggtcctacggtaggtggaccggtagggtccggggtacgaagggggacctaaggtacgttttaccaacgtaaactacgaaaacgttccgaacggggtacccggggtaggagggttaccgtagggtaacgggtagtttggtttacgggtactttaagtttttagttacgtttggtaactagttacgttaaaccgttaaagtttacgacgttccgtttcggtttacttaccggttttcggggacccggtaacggggtacctaccgttaccggtacggtaaactaacgttacgaaaacccggg

SEQ ID NO: 105362 - DNA, 680 bp, Homo sapiens
  misc_feature: GYAE6OF01CMCFR.29.71.G05.1.454.CMB.1.raw
  modified_base (513)..(513): a, c, t, g, unknown or other
  misc_feature (513)..(513): n is a, c, g, or t
tcagatagagtactcacgaccggtgctcgatttagtgtcgtcgcaagagagagggggtcaggctggaactgaggagcaggtgggggcacttctcctctaacactctcccctgttgaagctctttgtgacgggcgagctcaggccctgatgggtgacttcgcaggcgtagactttgtgtttctcgtagtctgtctttgctcagcgtcgagggtgctgctgaggtctggtaggtgcttgtccttgactaagtgctcgtggaactaccgtggactcgaggtggatagttagttcgagacgtcggaaccccgtagtccctacctacttccttccgttcgttaccgtcccgtaccctaccccggtggaaacccgccgggtcccgtacccctcgtaacttccgtacctcgtaactacgtctacggtacgacgtacgtccgttacggtcgtactaagttaggtagtaacgtaaggtaaaccgtaccttaagttacgtacggttaacgtcggttaacccgngaaccggtaagacgtaccgacgaccaccgtcccgtaaccgaccgtacccgtcttagttacgtttacgtaagttaaccgtttcgtaaggtttacgtttagttggacgttcggacacggttacgacggtctacggttacggacgcggaacgggtcggttacgaaacggg

SEQ ID NO: 105363 - DNA, 726 bp, Homo sapiens
  misc_feature: GYAE6OF01EBTYV.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccaggtggagatattgagatgacccagactccactctctctgtccgtcacccctggacagccgcctcatcctctgcaagtctagtcagcgcctcgtgctataggtgaagtaggaaaacgtaccttatagtgttactggtacctgacaagacgtcaggccagccctacacgtaccttcctagtaactttatacggtaacgttttaccgaaaggtttccggtttagtttttagggacgttcgacccgaaggacgtacggcgttacgaacggttcgggaccgtaacgggtcggggttaacgaacgggggtaactaaggtttactttaaccgaaacgttaaccggttaagtaaaacgttccggaacggggtacccgggggttagggaacggttaccgggtagggtaacgggttagttacgggtttaggtaacctttaagtttttaagtttacgttcggaacttacgtacggttaaacgttaaaaggtttacgacggttaccttttacggtttacgttaacgggtttccgggaccggtaaccggggttacctacggtccggttaacggaacgttaacgtaaaacccgg

SEQ ID NO: 105364 - DNA, 755 bp, Homo sapiens
  misc_feature: GYAE6OF01AZJN2.29.71.G05.1.454.CMB.1.raw
tcagatagagtactcacgaccggtgctcgatttagtgtcgtcgcaagagagagggggtcaggctggaactgaggagcaggtgggggcacttctccctctaacactctccctgttgaagctctttgtgacgggcgagctcaggccctgatgggtgacttcgcaggcgtagtactttgtgtttctcgtagtctgtctttgctcagcgtcgagggtgctgctggaggtctggtaggtgctgttccttagctaatcgctcgtaggtactaccgtggactccgaggtaggagtaattagttggaagtactaccggaaccccgacgtaacccttcccctaaccttccttccgttccgttccggttaccccgtaccccgtaacccccgtacggacccgtaccggtcccccggtacccctccctacgttccctacccgtagacctaacgttcttaaccggtctaacgggtaccgtcccgttcggtagacctaagttacggtacgtaaggtaacgggtaaacgttaacccttagttacgttaacgtttacgtaccgttaccgaggacgtaagacgtccgaacggtcccaaccgtccctaacccgaccgttacccgtacttagttaactttacggtacgtttaaccgttaccgtaaggttttccggttttaagtttagggtacgttaccggaccgtaaacggtcgtacggttcctacggggtacgtcgggaaccggcggggttacggggtaaggtaaacccgggg

SEQ ID NO: 105365 - DNA, 788 bp, Homo sapiens
  misc_feature: GYAE6OF01EU7BC.29.71.G05.1.454.CMB.1.raw
  modified_base (209)..(209): a, c, t, g, unknown or other
  misc_feature (209)..(209): n is a, c, g, or t
tcagatagagtactcacgaccggtgctcgatttagtgtcgtcgcaagagagaggggggactgatcaggacttctcagttcatcttctcaccatgaggcctccctgctcagctccgtggggctgctaatgctctggataccgtggatccaggtggagattattgagatgacccagacctccactctctctcgtccgtccacccgtggacncgcccgcctcactcctcctgactaagtctaggtcagacgccgtgtcgactagtagtagaagtaggaaactaccttagtactggttacgtcggtacctagaccgaaggtaacgtccggacggaccctaccggcccctacccgaccgtaccttccgttagttaactttaagtacggtttaaacgtttaccgttaaaggtttcggtttttaagttttacggggtagttaccggtaacctaacgggaccgtacggggtaccttacgggtacgggtcgggtacggtaccgggggcgggtacggaacggggacttaaggtttaaccgtttaacgaaaccgtaacgttaaacggtaaaacggtccggtaaaccggggtccggggtagggtacgggtcgttagggggaggttacggttgggttacggtactttaagttttaggttattcgtacgtacgttaggttaaaccggtttaaacgttacgtacgtttgtaccggttttacgttaaccgggtttccgggaacccgggttaacggggttaccctacgggttacccggtaacggtaaccgtaacgtaaaaccggg

SEQ ID NO: 105366 - DNA, 638 bp, Homo sapiens
  misc_feature: GYAE6OF01BHWZW.29.71.G05.1.454.CMB.1.raw
  modified_base (212)..(212): a, c, t, g, unknown or other
  misc_feature (212)..(212): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtcctgctaatgctctggataccgtggactccgagtggatatattgagatcgaccagacctccactctctctcgtcccgtccaccccgtggacctacgcccggccctacacttcctccgtgtacctacgttctaacggtcacgacgtccctgtcgacgtaagttacggtagtaacgtaagggaaaactaccgtttaatacgttacgttacgttacggtaccctgacgaaggtaacgtccgaacggacccacggtcccctacccgaacgtacccttacccgttagttaattttaacgtacggttaaccgtttaccgaaggtttccgtttttaaaggtttgggacgttaccgaccgtaggccgtaggacctcgggtaacgtcgggaacgcggtcggggtcgtaacggg

SEQ ID NO: 105367 - DNA, 684 bp, Homo sapiens
  misc_feature: GYAE6OF01BJR1F.29.71.G05.1.454.CMB.1.raw
  modified_base (222)..(222): a, c, t, g, unknown or other
  misc_feature (222)..(222): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagacctccactctctctcgtcccgtccaccccgtggacacgcccgctccatcctccngactagtctagtcagcgcctcgtgactaagtaggtagagtaaggaaactaccttatagttcgtacgtcggtacctagacgtaaggaacgtcgacggaccacgtccctacgaacgtaccttcgttagtactttagtcgttaacgtttaccaagtttcgttttaagttagggacgttcgaccgtaggacgtacgtctagaggttacgggacgtacgggtcggtacggaacgggtacgtagttacgttacactaacgtaaagtaacgtacggtacgggtcgggtaggacggtgtagggtaacggttgttggttagtacgtttaagtttacgtttacgttagtacgtagtacgtaaacgttaacgtttacgtacgtttacggttacgtttacgttacggtttcgggacccgttaacgggacccgttacgttaccggtacgtaacgtaaccgtaaaccgttaaacgg

SEQ ID NO: 105368 - DNA, 657 bp, Homo sapiens
  misc_feature: GYAE6OF01ALS03.29.71.G05.1.454.CMB.1.raw
  modified_base (155)..(155): a, c, t, g, unknown or other
  misc_feature (155)..(155): n is a, c, g, or t
  modified_base (465)..(465): a, c, t, g, unknown or other
  misc_feature (465)..(465): n is a, c, g, or t
  modified_base (509)..(509): a, c, t, g, unknown or other
  misc_feature (509)..(509): n is a, c, g, or t
  modified_base (543)..(543): a, c, t, g, unknown or other
  misc_feature (543)..(543): n is a, c, g, or t
tcagatagagtactcacgaccggtgctcgatttagtgtcgtcgcaagagagagggggtgatcaggacttctcagttcatcttctcaccatgaggctccctgctcagctcctgggctgctaatgctctggatacctggatccagtggagatatgantcgtacccagacctccactctctcctgtcccgccaccccgtgaccacggcccgtccctcctctccgtcctcgacctaagtctaggtacaggacgtcctggtcgactagttagtacgtagtaggaaaacgtacttataacgttacggttaaccgttcgggttaaccgtggtaaccgtaacgtaaacgggtccgaacgggtaccaaccggtcccctaaccgaacgtaccctccgtaagttacttaacggtcgttaaaacggttcaacgttcgttagtttacggacgtcgtaccgaacgtacggtagtctacnggttcggcaggtcggcgagggactacgtcttacgactacgtaanaacgtcgagggtccgaggtgacgtaggaggtacnggttacgattcttaaagtgtagacctagtacgtaacgttagtaccgtagtacgttcgttacgtgttacgccgggtaaactacgtacgtcggttagacctagtaaccgtaaacgg

SEQ ID NO: 105369 - DNA, 783 bp, Homo sapiens
  misc_feature: GYAE6OF01DHN25.29.71.G05.1.454.CMB.1.raw
  modified_base (149)..(149): a, c, t, g, unknown or other
  misc_feature (149)..(149): n is a, c, g, or t
  modified_base (158)..(158): a, c, t, g, unknown or other
  misc_feature (158)..(158): n is a, c, g, or t
tcagatagagtactcacgaccggtgctcgatttagtgtcgtcgcaagagagagggggtgatcaggacttctcagttcatcttctcaccatgagctccctgctcagctccgtggggctgctaatgctctggatacctggatccagtgganatattgagntcgacccagacctccacttctcctctcgtcccgtccacccgtggaccacgcccgtcctccattccgtcctagactaagtcctagacagacgtcctcgtgactagtagtagagtaaggaaacgtaccttaatacgtgtaacgttacgtaacctaggacgtaaggtaacgcgacggacccaacgtcccttacccgaacgttaccttacccgtagttaattttaacgtacggttaaccgtttaccgtaaagtttcggttttaaggttttacgggaacgttaccgaaccgaaacggtacgtaacgggttcctaaggtacgggttacgggacggacggggttaccggtaacggaacgggtaacgtaacgttactttaccgaaacgtaaaccgttaagtaaacgtccggtaacggggtaccgggttaagggaacggtacggtagggtaaggtcggttaaggtttacggtaacgttttaattttaacgttagtcgtaactacggtaacgttaacggtttaaacgtacgtacgttaccgggtttctttacggtttaaccggtttccgggaaacccgggttaagggaccccttaggtaacccggtaataaacgtaccgtaaaacgtaaaaccgg

SEQ ID NO: 105370 - DNA, 752 bp, Homo sapiens
  misc_feature: GYAE6OF01BR9X1.29.71.G05.1.454.CMB.1.raw
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (281)..(281): a, c, t, g, unknown or other
  misc_feature (281)..(281): n is a, c, g, or t
  modified_base (403)..(403): a, c, t, g, unknown or other
  misc_feature (403)..(403): n is a, c, g, or t
tcagatagagtactcacgaccggtgctcgatttagtgtcgtcgcaagagagagggggtgatcaggacttctcagttcatcttctcaccatgagctccctgctcagctccgtgggctgctaatgctcgtggatacctggactccagtgganatattgagatgaccagctccactctctctcgtccgtccacccgtgacncgccgtcctcatcctctgacagtctagcagcgcctgncagtagtgagtaggaaactacctatagttacgtacctcggttaccngacgaaggaacgtcgacgtccacgtccctaccgacgtacctccgtagttacttacgtaggtacctttaccgacgtttacgtttagtttcgggactcggtaccgaacggtaacgcgggtaccncggtaggtcggaccgtacgggtacgggtaaccggtaagggtaaccttacgtaacgtttaccgaacccgttaagtaaacggtaaacgttcggaaccggggtaccgggtacgggaacggttacggtagggtaacgggtacgtttacgggttaacgtacgttttacgttttaacgtttacgttacgttaacgtaacgttaacgtaacggtttaaacggtttaaccgtcggtttacgttacccggttttaggttaacccggttaccgggtaacccgggttaaacgggttaacccgttaacccggtttaccggtaaaccggggtacctttaaacgggtaaacccgtaaaccggg

SEQ ID NO: 105371 - DNA, 722 bp, Homo sapiens
  misc_feature: GYAE6OF01B7QQ3.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcgaggcgtagtactttgtgtttctcgtagtctgtctttgctcagcgtcgagggtgctgctggaggctgtacggtgctgtccttgactaagtgctctggactaccgtggtactccgaggtggaagtattagttaggagtataccgaaccgacgacctacctactctctcgtccgtacccgtcccacccgtacggaccgtaccggcccggtccctacctacgttcccgtaccgtacgtaccgtaacggttactacggtacgtacgaccgtccgttacggtcgtactaggtagtacggtaagtaacgggaaacctaccttaagttacggttactaaccgggtttacggtaaccgtacgtaaccggtaaacgggtaaccgttcggaacccggtacccgtaccgttacccccgtaacccgtaaccgtaccctttacgttaacgttaacgttttaacgtacggttaacgtttaccgaacgttttaggtttacggtttacggacgttccggacacggtaaccgcgtaccgtaggtacgtacgggacgtacgggtcggaccggtaaagg

SEQ ID NO: 105372 - DNA, 841 bp, Homo sapiens
  misc_feature: GYAE6OF01C5QY0.29.71.G05.1.454.CMB.1.raw
  modified_base (129)..(129): a, c, t, g, unknown or other
  misc_feature (129)..(129): n is a, c, g, or t
  modified_base (223)..(223): a, c, t, g, unknown or other
  misc_feature (223)..(223): n is a, c, g, or t
tcagatagagtactcacgaccggtgctcgatttagtgtcgtcgcaagagagaggggtcaggctggaactgaggagcagggtgggggcacgttctccctctaacactcctccctgttgaagcttctttgngacgggcgagctcacggccctgagtgggtgaccttcgcgaggtcgtagtactttgtcgtttctcgtagtctgtctttgctcagcgtcgagggtntctgtctagaggtcgttaggtaggtctcgttcgttccgtttagacttaagttcgtcgttcgtcggtaacttaccgtaggtacctaccgtagggtaggtaagtaattagtacgacgtacgtaccggaacccacgtaccctacctaccgttccttcctttccgtccggttaccccgtaccccgtaaccccgtaccggaacccgtacccggtccccggtacccttacccgtacttccccgttaccgtacggaccttaaacgttccgtaaacgtcccggacgaccggtccgtcggtaacgtacgttaagtacggtaaggtaacgttaaaacgggaaaccttacgttaacttaacgggttacgttaaccggttaaccggtttaaccggacgtaaaccggtaaagggtaaccgtaaccggacggaccccgtaccggtaccccttaacccggtaacgtttaaccgttccgttaagttaactttaacgttaacgttaccgtttaacggtaacggttttacggtttacgtttaccgggacgttaaccggaacgtaaacggtacccgtaggttacccgtacggtacgggtacggacggttaaaccggggcggttaaagggtaaaccgg

SEQ ID NO: 105373 - DNA, 668 bp, Homo sapiens
  misc_feature: GYAE6OF01EDA92.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagacctccactctctctcgtcccgtccaccctggacacgcccggcctccatcctcctgaccaagtctagtcagacgcctcgtgcatagtagataggaaacgtacctatatgtacgtcggtacctgacgaaggacgtcgacggccacgtccctaccaaccgtacctcctacgtatttatacgttaacgtttaccaaggttcgtttagtttggagttcgacagacgcggactcgaggtcgggacgacgggtaccggggtcgaagggtactaacggttactttacgaaccgtaagtaaacggaaacttccggagggtacccggggtagggacggtcgttaggaacgggttagttacgggttacggtactttaagttttaacgttagttcgtactagttacgtaaactttaaagtttacacggtttcgttacgttttaccgttacggttttccggaccgggtagggtaccctacgttacccgtagggaacctaacgtaaccgtaaacg

SEQ ID NO: 105374 - DNA, 643 bp, Homo sapiens
  misc_feature: GYAE6OF01ANVLX.29.71.G05.1.454.CMB.1.raw
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
  modified_base (368)..(368): a, c, t, g, unknown or other
  misc_feature (368)..(368): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctcgtccgtcacccctggacngccggcctccatctcctgcagtctagtcagagcctcgtgacatagtgataggaaanacctatatgtactggtacctgacagaacgtcaggccacgcctccacgacctccgtagtatttatcgtaagtttccaaggttcgttttagttttgggattcggccaggtacnggtctcgaggtggcgaggcgggtacgagggtaccaggtactttaccactaacgtagaaaacgtcgaccgggcggggtagggtacggcgttagggaagggtagtttcgggttgggactttagtttttaagttagtttacgacgtagttacgtaacgttaaaaggttttaccgtaggttaccgtttagttttacccgttaacggtttttaccggggcccggttaaaccgggggtaccctaccggttaccggtaacgggaaccttacgttaaaacccg

SEQ ID NO: 105375 - DNA, 747 bp, Homo sapiens
  misc_feature: GYAE6OF01A4TAV.29.71.G05.1.454.CMB.1.raw
  modified_base (252)..(252): a, c, t, g, unknown or other
  misc_feature (252)..(252): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggactccagtggagatattgagatcgacccagacctccactctctctcgtccgtaccaccctggacacgcccggcctccatcctacctgactaagtctagtccagacgcctgtncctataggtacgtaatacgggaaaactcttaatacgttcgtaacgtcggtaacctgacgaagacgtcgacggtcccaacgtcccctacgaacgtaccttaccgtagttaactttacgtacgttaaacggtttccctaaaggttccgtttttaagtttacggggacttaccgggaacctaacgggaccgtacgggtaccttacggaacgggtcggtaccggagggtacccggggtacgtaaggggaccttaacgggtactttaaccgaacgtaacgtaacgaaacgttccggaaccgggcggggttaggacggttacgtacggaaggttacgtaggttacggtacttttaagtttacgtttacgtacggaccttaagtccggttaactttaaacggttaccgtaagttccgtttaggttacccgttacggtttacccggaccggttaaccgggtaccttacgttaccccggtaagtaacccgtaacgttaaaccgg

SEQ ID NO: 105376 - DNA, 752 bp, Homo sapiens
  misc_feature: GYAE6OF01EOWER.29.71.G05.1.454.CMB.1.raw
  modified_base (743)..(743): a, c, t, g, unknown or other
  misc_feature (743)..(743): n is a, c, g, or t
tcagatagagtactcacgaccggtgctcgatttagtgtcgtcgcaagagagagggggtcaggctggaactgaggagcaggtgggggcacttctccctctaacactcctcccctgttgaagcttctttgtgacgggcgagctcaggccctgatgggtgacttcgcgaggcgtagtactttgttgtttctcgtagtctgtctttgctcagcgtcgagggtgctgctggaggtctggtaggtgtcttcgttccttgacttaagtcgccttcgtacggtacttaacccgtggtactaccgtaagggtggaacgtaagttaagttggaacgtaagtaccgaaaccccgtaacgtacccttaccctaacctttccgttccttccgttccgttaccccgttacccctaccccgtacggaaccgaccggtcccccggtccctacctaccgttcctcccgttacgaccgtaacgttccgttaacggtacccgaacggtacccgttcccgttcggtacgtacttaagttacggtactaaggtaaacgggaaaacttacttaagtaacgtacgttacgtaccggtactacggtaccgaaaggtaccgtaccgacgaccctaaccgtcccgtaacccaacgttaccctccgttaagttaactttacgtaacgttaaccgttacgtaagttaccgttttaggttacgacgttcgaaccgtagacgacgtcgacgtacggtgaccgggaggttcggnggtaaacgg

SEQ ID NO: 105377 - DNA, 698 bp, Homo sapiens
  misc_feature: GYAE6OF01ETF5U.29.71.G05.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (416)..(416): a, c, t, g, unknown or other
  misc_feature (416)..(416): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggactacctggatccagtggagatattgagatcgaccagacctctactctctctcgtcctacacccnggacncgccgcctcctatcctcctgactaagtctagtcacgacnccgtcgngactaagtagtacgagtaggaaactaccttaagtagtacgtacgtacggtacctaggacgaaggtaacgtcgacggaccacgtccctacaccgtactaccgtagtaattagtacgttaacgttacaaagttcgtttaagtttggagtcgaccgtaagacgcgtctacgngggtacgccgagggtagggtaccggaagtactaacgtacttacgaaactacgtaaagtaaacgtccggacgggtccgggtagaacggtgtacggtaggttacgttggttaccggtaatttaacgtttttagttacgtcggtaactagtttaaccggaaattttaaacggttacgacggttttactttaccgggtttaacttttgggttaacccggcccgggttaaagtaccccgtttaaacggtccggtaaacgttaacgtaacgtaaacccggtaaaccgg

SEQ ID NO: 105378 - DNA, 817 bp, Homo sapiens
  misc_feature: GYAE6OF01BN9TI.29.71.G05.1.454.CMB.1.raw
  modified_base (253)..(253): a, c, t, g, unknown or other
  misc_feature (253)..(253): n is a, c, g, or t
tcagatagagtactcacgaccggtgctcgatttagtgtcgtcgcaagagagagggggtgatcaggacttctcagttcatcttctcaccatgagctccctgctcagctcctggggctgctaatgctctggactaccgtggatccgagtggagattattgagatcgacccagacctccacttctctcgtgtcccgtccaccccgtggacacggcccgcctccatcctcctgacaagtctagcagcgtcctcggtnactaagtagacgaagtacggaaactacctattaagtcgttacgtacggtacctagaccgtaaaggtacggtccgacgggacctacgcccctaccaccgtacctccttagttattttacgtaggttaaccttacgtaacggtttacgttttaggtttggacgttacgaccgtaagtaccgtacggtctacgtacgggtcgggtaacgtacgggtaccggggtacggaacggtaaccgtaagtttacttaaacccggaaacctaaggtttaaaacggaaccgttaccggggaaccggggtccgggtaacgggaggttacggttagggacggttaacggtttcggttaacgggttaacttttaagtttaacggttacgtcggttaacgtaaacggtttccgtaaaaagggtttaaccgtttaaccggggtaaccgtttccgtttaaacgggttttacccggtttaaccggggtttaccgggtaaaccccggggtacggggttaacccccttaggggttaacccccgttaggaaacccgttaaaccgtaaacccgggttaaaaaccgg

SEQ ID NO: 105379 - DNA, 859 bp, Homo sapiens
  misc_feature: GYAE6OF01CO8MJ.29.71.G05.1.454.CMB.1.raw
  modified_base (685)..(685): a, c, t, g, unknown or other
  misc_feature (685)..(685): n is a, c, g, or t
tcagatagagtactcacgaccggtgctcgatttagtgtcgtcgcaagagagagggggactgatcaggacttctcagttcatcttctcaccatgaggcctccctgctcagtcctccgtggggctgctaatgtctcgtaggacttaccgtggactccgaggtaggagtattagttgagactcgaacccagacctcctactcttctcgtcgtcccgtcccacccgtggaccgcgcccggtccctacctacgttcccgtccgtacgaccgtaacgttcgttacggaccaacggtaccgtcccgttccggtgtaacgtaaggttacggtaaggtaaacgttaaacggggtaaaaccgttaacctttaaagttaggttaccggtaacgtttaccgggttaccgtacggaacggaacggttaaccggtaccgacccggaccgaaccccgtaccccgtacccgtaacccgttccgttaccggtttaacttaacgttttaacgtaaccggtttaaaccgttttaaccgtaacgggttttagttttaggtttcggtacgtacgtaaccgacggaaaggtcgtcgttaggaacggtgggaccggttacgggacggggtaccgtaagggtaactaggtttaccctaagaaacgtacgtaaacgtaacggttcggacgggtaccggggaggttacggnggttagggtaaggttcgtttagggtacggtttaacttttaggtttacgttgtaacgtagttaagaaccgtttacggtttaaatcggtttattaccggtttaccgttacggttccggggtcgaacgggtaccgggttacctaccaaccggttagtaaaccgtaccggtaaaccgg

SEQ ID NO: 105380 - DNA, 639 bp, Homo sapiens
  misc_feature: GYAE6OF01A0WVW.29.71.G05.1.454.CMB.1.raw
  modified_base (215)..(215): a, c, t, g, unknown or other
  misc_feature (215)..(215): n is a, c, g, or t
  modified_base (464)..(464): a, c, t, g, unknown or other
  misc_feature (464)..(464): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtggacgggcgagctcaggccctgatgggtgacttcgcaggcgtagactttgtgtttctcgtagtctgtctttgctcagcgtcgagggtnctgctggacggcgtggtaggtgctgttccttgactaatgctcgtggaactaccgtggactcgaggtaggatattagttggaagtcgtacgacctagacctctacctctctcgtcgtcctccacccgtgaccgacgtcccgtcctaccatccgtcgtgactacgtctagtcaacgcgtccgtagtacgacgtaagttggcgtaaagtacgggaaactaccttaagttacgtgttaaccgtcgtacacganaacgtacgtaccacggtcccacgttcccgactacctaccgttacgtacgtttatttactaaccgggttaagttacccgtaagtttaccgttttaggtacggacgtacctacggtaacggtccgtcggacgttacggtagggaccggtgggaaccgggttcggtaagggaacccgg

SEQ ID NO: 105381 - DNA, 604 bp, Homo sapiens
  misc_feature: GYAE6OF01A8R8A.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgagtaggaaagacctatatgtactggtacctgcagagtcgacggccacgcctccacgtctcctgtaatttatgtaagtttccaagtcgtttaagttttggagtcgacctagacgaggtctacgaggtcggcgaggcgggtacgagggacaggtacttcaacagtagaaattcgaacggtcgggtaggacggtagtacggaggtagttacggttaggtacctttaagttttaagttagttcgtactaagtacgtaacgttaaaacgtttacgacgttcgttaggtttaccgttacgttttccgggaacccgtaacggggtaccctaacggttcccgtacggacgtaacttaaacccgg

SEQ ID NO: 105382 - DNA, 689 bp, Homo sapiens
  misc_feature: GYAE6OF01AMMCG.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatcgacccagactccactctctctcgtcctccacccgtggaccacggcccgcctcatcctcctgacaagtctagtcagacgtccctcgtcgactataggtgaagtaagggaaacgtacctattagtcgttaacgtcggtacctgacgaaggtaacgtcgacggccacgtccctaccgaccgtaccttccgtagttaactttcgtacgttaacgtttaccgaagttcgttttagtttcggacgtcgaccgacgacgtacggtcctcgaggtcggcgtacgggtcggtacgagggtaactacgttacgttacgaacgtaacgtaacgaaacgtcggacgggtccggggtaggaggtacgtagggacggttagttcgggttacggtaactttagtttttaagttcgttacgacgttagtaacggtaacgtttaaacgttcgtacggtttctttacggtttaccgtttcggttaccgggaaccggtaaccgggttactaacggtacccgtaacggtaaccttaggtaaaacccg

SEQ ID NO: 105383 - DNA, 739 bp, Homo sapiens
  misc_feature: GYAE6OF01BEDI5.29.71.G05.1.454.CMB.1.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
tcagatagagtactcacgaccggtgctcgatttagtgtcgtcgcaagagagagggggactgatcaggacttctcagttcatcttctcaccatgaggctccctgctcagctccgtgggctgctaatgctcgtggactacctggactccagtggagattattgagatcgacccagacctccactctctcgtcgtccgtccaccccgtggaccacggcccgtcctccatcctccgtgactaagtctagcagcncctcgngctagtagngagtaggaaacacttatactcgttacgtggtacctgacgaagtaacgtcgacggcccacgccctacgacgtaccttcgtagttaatttacgacggttaacgtttcccaaaggttcgttttaagtttcggacgttacgaccaagggaccgtacggtcctacggtacgggtcgggaccgacggggtaccgggtacggaacgggtaacgtacgttacgttaccgaacgtaacggtaaagtaaaccgttacgggacgggtaccggggtaggacggtacggtaacggtagggtacgttacgggtttacggtaacgtttaagtttttaggttacgttacggtacgttaacgttaacggtaactttaaacggttacgttacggttacgttttacggtttacccgtttcgggtttaccgggaacccggtacggggttaacccttacgggttacccgtaagttaaccgtacgtaaaacccggg

SEQ ID NO: 105384 - DNA, 657 bp, Homo sapiens
  misc_feature: GYAE6OF01DHCYJ.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgctcagcgtcgagggtgctgcgtgaggtctggtaggtgcttcgtccttgactatcgctcgtggactacgtggtactccgagtggatattattgagtatcgaccagtacctccactctctcgtcgtcccgtctaccctgaccgacgccgtacctcgtactcctctcgactaacgtctacgtacacgtacgccgtgtcgactacgtaggtacgtaggttaacgaaacgtactagtagttacgtaacgttcggtaccgtgaacgtagaacgtccgacggtccaccgtccctaacccgtaccggtacctttaccgtagtttaacgtttacgttaacggtttacctttaccggtaacgttttacggtttagttttacgggacgttaccggaacccgtaaggtaccggtacggtacgttacgggtacgggtagacccgggtacgggtacggggtagtaaaccgggg

SEQ ID NO: 105385 - DNA, 826 bp, Homo sapiens
  misc_feature: GYAE6OF01C8MU4.29.71.G05.1.454.CMB.1.raw
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (317)..(317): a, c, t, g, unknown or other
  misc_feature (317)..(317): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctcgtggataccgtggatccgaggtggagtattagttgagatacgacccagacctccacttcctctcgtcgtcccgtacccacccgtggaccacggcccggcctccactcctcngactacgtctagtcaggcgcctcgngactaagtagacgagtaaggaaactacttaatacgtcgtacgttcggtaccgngacgaggacgtaccgacgggccctacggcccctaccgtaccgtaccttaccgtagttaagtttacgttaacggttaacgtttaaccgtaagggtttacgtttttacggtttagggaaccgttccggaaccgttaacgggaccggtacgtaccgttacgggtaacgggtcgggaccggaccggggttacggggtaacggtaacggggtacttaaacgtttactttaaccgaaaccgtaaaggtttaaacggaaaccgtccgggggtaccggggtaccggggtaaggtaccgggtgttaacggggaagggttttccgttttagggggtaacgtttaaacctttttaaagtttttccgaagtttaccggaagttaacgttaacggtaaacgtttaaaccgtttacgacggtttaccttttacgggttaaaccgtttttcgggtaaccggggaaccgttaccgggtaacttaccggttacgaaagttaccgtaaagaaacccggtttaaacgg

SEQ ID NO: 105386 - DNA, 801 bp, Homo sapiens
  misc_feature: GYAE6OF01AQKUM.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggactaccgtggatccaggtggagattatgagatcgacccagacctccactctctcgtcgtccgtccacccgtggacacgccgcctccactcctctgacaagtctacgtcaggacgtcctcgtgacctaagtaggtacgaagtacgggtaaaactacccttaagtacgttcggtaaccgttcgggtacctaggacctaaggtaaccgtcggacggtacccacgtaccccgtaccaccgtaccttccgttaagttaacttttacgtacggtttaaacgtttacccgtaacggttttacggtttaaggttttacggggtacgttaccgggtaacccgtaacggtaaccggtccgggttacccgttaggtacgggtacccggggtacgggtaaccgggtaccgggggttaacccgtaagggggtaaccttacggtttaacgtttaaccgaacgttaaccgaaaaggttaaaccggtcgggtaaccggggtccggggttaagggacggttaccggtagggtaacggttaggtttcgggtacggttattttaagtttagttagtttacgaccgttagttacgtaacttaaagttactacgttacgttacgtttcgttacgggttacggacccggtagggttaccctacgtccggaagtacaacggttacgtaaacgg

SEQ ID NO: 105387 - DNA, 755 bp, Homo sapiens
  misc_feature: GYAE6OF01BG4X6.29.71.G05.1.454.CMB.1.raw
tcagatagagtactcacgaccggtgctcgatttagtgtcgtcgcaagagagagggggtcaggctggaactgaggagcagggtgggggcacttcctccctctaacactcctcccctgttgaagcttctttgtggacgggcgagctcgacggccctgagtgggtgtacgttcgcgaggcgtagtacgttttgttgtttctcgtagtctgtctttgctcgagcgtcgtagggtgctgcgtggacggtcgtggttaggtcgtcgttcggttccgttggtacttaacgtcggtccgttacggtacggtaacgttaccgtacggtaccgtacggtaaggtaggtaagttaagttacggtaggtacgtacgtaacccgaccgaccgtaccctacctaccgttccgttccgttccgttcccgttacccgtacccgtacccggtacggaccgaccgtcccgtcctacctaccgtccgtaccgtacgtaccgtacgttacgtacgtacgtacggtaccgtccgtcgtacgtacgtaggttacggtaacggtaacggtaaacgtaacgttaacgttacgttacgtttacggtaccgttacgtaccgtacggaacgtaacgtacgtaccggacgccgtacccgtacccgtaccgaccgttaccgtacgttagtttacgttacgttaacgttacgttacgttacgtttacgttagtcgtacgtcgacgacgtcgacgtcgaggtcgtacggacggtcggcgtaggacg

SEQ ID NO: 105388 - DNA, 815 bp, Homo sapiens
  misc_feature: GYAE6OF01ETFZC.29.71.G05.1.454.CMB.1.raw
  modified_base (265)..(265): a, c, t, g, unknown or other
  misc_feature (265)..(265): n is a, c, g, or t
  modified_base (307)..(307): a, c, t, g, unknown or other
  misc_feature (307)..(307): n is a, c, g, or t
tcagatagagtactcacgaccggtgctcgatttagtgtcgtcgcaagagagagggggtgatctggacttctcagttcatcttctcaccatgagctccctgctcagctctgggctgactaatgctctaggatacctggatccagtggagatatgagatacgaccagacctccactctctctcgtcccgtaccacccgtgacgacgcccgcctcctatcctcgtagacgtaagtcgtagtacgagacgtcctcgtagctaagttagngaagtaaggaaactaacctagttactcgtaacgttcggtacncgacgtaaaggtaaccgtcgaacggacccacgtaccctaccgaaacgtccttacctaagtaattttacgaacggtttaaaccgttacgtaaacggtttcggtttttaacggtttacgggacgtttaccgaaccggtaaacggttaaccgaacgggttcccgtaaaggtacggggttacgggaccggtaacgggggtaccgggtaaccggtaaagggaaccgttagtttaaaccttacgaaacccgttaaagtaaacgtaaacgtccgggaacggggtccgggttacggaggtccggtaaggacgggtttatacgggtttaactagtttaagttttagtacggttacgacgttaacgttacgtaaaacgttttaaccggttaaagccgttaaggttttaccggttttaacgttacggtttaacccggggacccgggttaaaacgggttaccccctttaggttaacccgttaggaaaccctttaaaccgaaaaccggtttaaaacccggg

SEQ ID NO: 105389 - DNA, 725 bp, Homo sapiens
  misc_feature: GYAE6OF01EU4M3.29.71.G05.1.454.CMB.1.raw
  modified_base (149)..(149): a, c, t, g, unknown or other
  misc_feature (149)..(149): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtgganatattgagatcgacccagactccactctctctgtccgtccaccctggacagccgcctccatctcctgcaagtctagtcagacgcctcgtgctagtaggtagagtaggaaacgtaccttatagtcgtaccgttcggtaacctggacgaaggtaacgtcgaacgggacccacggccctaccgaacgtaccttcctaggttaattttacgtaggttaactttacgaaagttcgttttagtttggagtcgaccagtacgcggtctacgtagggtcggacgtacgggtacgggtacgaagggtactaagttactttaccaacgtaacgtaacgtaaatccggaacgggtaccggggtaggacggtcggtaggtacgggtagttcgggttacgtacgtttacgtttttaagttacgtttacggacgttaagttaacggtaacgtttaaaacggttttaccgaacgggtttaccgtttacggttttaaccggtttaccgggtttttaccgggaaccgggttaacggggtaacccttacggttacccgttaacggtaacctaacgttaaaccggtaaaaccggg

SEQ ID NO: 105390 - DNA, 677 bp, Homo sapiens
  misc_feature: GYAE6OF01CJDNF.29.71.G05.1.454.CMB.1.raw
  modified_base (212)..(212): a, c, t, g, unknown or other
  misc_feature (212)..(212): n is a, c, g, or t
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgcctctggattaccgtggatccgaggtggagtatattgagatcgacccagacctccactctctctcgtcctccaccccgtggaccncggcccgcctccatcctccgtgactaagtctagtcaaggcgtccctgtanctatagtgataggaaactctatntgtacgtcggtactgcaagtacgcacggcacgccaccgactctctagtattagtagtaactttacgaagtttcgtttagttttcggaacgtccgaacacgtacgtaggtccttacggtaggtccggacgtacggggtaaccgggtggaacgggtacctaagttactttacccgaagaacgtaacgtaaacgtcggaccgggtaccggggtaggtaggtacgtagggtaacggttaagttcgggttacggtaacgttttagttttacgttacgttagtacgtaaagttacgtaacgtttaaaagtacgtcggtttacgttcgtttaacggttcgtttacgggaccgttaacgggtaacccttcgtaacgtacggtaacgtacctaaaaccggg

SEQ ID NO: 105391 - DNA, 640 bp, Homo sapiens
  misc_feature: GYAE6OF01EKORB.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccgagtggagtattattgagatcgaccagacctccactctctctcgtccgtccacccgtggacacggcccggcctccactcctcctgacctaagtctagtcgacgacgtcctcgtgactaagttaggtagtaagtaaggaaacgtaccttaattagttacgtacgttcggtactgactaggaacgtcgacggccacgtcctacgacgtaccttcgtagttactttagtacgttaacgttacgtagttacgtttagttacggaggtccgacgtagaccgtgtacgtagtggacgcgtagggcggtacgagtagtattactacaactacgtaacgtaacgtcggacgggtcgggaggtagtcgtagggtagtacggttcgttacgtattttaagtttacttgtacgtagtagttactaaagtttacgttacgtacgtttcgttacgtttacgtacggttccggacggtacgtactcgtagtaccgaattaacgtagtaacgg

SEQ ID NO: 105392 - DNA, 879 bp, Homo sapiens
  misc_feature: GYAE6OF01DRSO9.29.71.G05.1.454.CMB.1.raw
tcagatagagtactcacgaccggtgctcgatttagtgtcgtcgcaagagagagggggtcaggctggaactgaggagcagggtggggcacttcctccctctaacactcctcccctgttgaacgcttctttgtgacgggcgagctcgacggtccctgagtgggtagtacgttcgcgaggtcgtacgttacttttgttgttttctcggtagtctgtctttgctcgacgtcgtcggtagggtcgcgtgtccgtggtcggtcgtaggttaggtctcgttcgtcccgttataccgtagtcgtcgttacgtacgtaccgttaccgtacgtaaccgtacggtaagggtagtaagttaagttaagtaggacggtaacgtaacccgaaccccgtacgtcccgttacctaccttcccgtttccgttcccgtacccggttaccccggtaccccgtacccggtaccggaccccggcccggtccccgtacccctacccgttaccgttacccgtaccgtaacgtaaccgtttaaccgtaccgtaacggtaccgtaccgttaccccggttccgttacggtacgtaaccgtttaagggtaacggtacggtaaacggttaaacggtaacctttaaacgttacttaacggttaccgtttaaccggttaccggtaccgtacggtaaccgtaacggtaccggtccggaccggtacccgtacccgtaccgtaacccgtaccgttaccgttagttacgtttaacgttttaccgttaacggtttacgtttaaacggttaccgggttttacgtttacgggtaccgtaccggtacgtaaccggacggtacggtacgtacggtacggtcggtacgggccgggtaacgggtaccgggaacgtaacgg

SEQ ID NO: 105393 - DNA, 785 bp, Homo sapiens
  misc_feature: GYAE6OF01DXCG7.29.71.G05.1.454.CMB.1.raw
  modified_base (162)..(162): a, c, t, g, unknown or other
  misc_feature (162)..(162): n is a, c, g, or t
  modified_base (341)..(341): a, c, t, g, unknown or other
  misc_feature (341)..(341): n is a, c, g, or t
  modified_base (452)..(452): a, c, t, g, unknown or other
  misc_feature (452)..(452): n is a, c, g, or t
tcagatagagtactcacgaccggtgctcgatttagtgtcgtcgcaagagagagggggtgatcaggacttctcagttcatcttctcaccatgagctccctgctcagcctccgtggggctgctaatgctctggatacctggatccgagtggagattattgagtntacgacccagtactcctactctctcgtcgtccgtccacccgtggacacggcccggtccctaccacttcctcctagacctaacgttcgttacgacgaaggtaccgtccgttcgtacgactagtaaggtacgtagtaagggaaacctaccttatacgttcgtacgttacggtacctcgganaacggtaacgtccgaaccggtccacgccccttacgaccgtacttctagttagtttaagtacgttaacgtttacgaagtttcgtttacgtttggacggttcacgtacgacgngtactcggagttcgagtacgggacggtcggaaggtccgtaagttacttacgaactaacgtaagtaacgtcggtaacgggtcgggtaggtacggcgttaacgggtacggttaaggttcggttacggttaaccgttttaagtttacggtttaacgttacggttaaccgtagttaaccggttaaacgttttaaaccggttacgttaccggtttccgtttaccggttttaaccggtttacccgggttttacccgggaaaccgggttacccggtaaccccggtttacgttaaccccgggttaggtaaacccgttcggtaaaaccccggttaaaccggg

SEQ ID NO: 105394 - DNA, 717 bp, Homo sapiens
  misc_feature: GYAE6OF01C3D2R.29.71.G05.1.454.CMB.1.raw
  modified_base (699)..(699): a, c, t, g, unknown or other
  misc_feature (699)..(699): n is a, c, g, or t
tcagatagagtactcacgaccggtgctcgatttagtgtcgtcgcaagagagagggggtgatcaggacttctcagttcatcttctcaccatgaggctccctgctcagcctccgtgggctgctatgctcgtgatacctggatcgaggtggagtattattgagtactacgacccagtacctcctacttctctctcgtcccgtccacccgtgacacgcccgcctccactcctctagactagtctagtcgagacgtccgtgtgactagtagttagaaggttaaggaaacgtactaatacgtacgtacgtcggtacctagacgaacgtacgacgaccggccacgccctaccacgtacctcgtagttattagtacgttacgttactaagttcgtttaggtttggaagttccgacgtacgtacgtagtaccgtaggtaggtcgacgtacgggtccggtaggaacggtaacgtacgttacttacgaactaacggtaagtaacgtcggaaccggggtccgggaggtacggtacgttaagggtacggtttaggtttacggttaggttatttttaacggttttattagggttacgtaacgtcgtttaacgtaaacgttttaacgttacggtacggttaccgttttagggtttacccgtttacgggttacccgggaaccgggtaacgaaccgttccgttacggtagtaaacnccgttaaacggtaaacgg

SEQ ID NO: 105395 - DNA, 688 bp, Homo sapiens
  misc_feature: GYAE6OF01D944Y.29.71.G05.1.454.CMB.1.raw
  modified_base (347)..(347): a, c, t, g, unknown or other
  misc_feature (347)..(347): n is a, c, g, or t
  modified_base (562)..(562): a, c, t, g, unknown or other
  misc_feature (562)..(562): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagattattgagatgacccagacctccactctctctgtccgtacaccccgtggacacgcccggcctcctatcctcctgcaaggtcctagtcagacgcctcggtgctatagtgaagtaggaaacgtaccttatatacggttaccgtggtacctggacgaaggagtccgaaggcccacgccctaccaccgtaccttacgtntaatttagtagttaacgtttaccgaaggttcgtttttaagttttcgggagtaccgtccgaagtaccgaggtccctgacgggtcggacgtagggtcccgggtagaggaacctaagttacttacgaacgtaacgtaagtaaactccggacgggttcggggacggagtcggagggtacggtagttacggggttgacttttaagttttaagttcgttanacgttattaggtaacgttaaacgtttacgtagtttaccgtttagtttaccgtttagggtttacccgggaccggtaaccggggtacccttacgggttaacccgttggaaacccttcgtaaaacccgg

SEQ ID NO: 105396 - DNA, 693 bp, Homo sapiens
  misc_feature: GYAE6OF01D7U4S.29.71.G05.1.454.CMB.1.raw
  modified_base (340)..(340): a, c, t, g, unknown or other
  misc_feature (340)..(340): n is a, c, g, or t
tcagatagagtactcacgaccggtgctcgatttagtgtcgtcgcaagagagagggggactgatcaggacttctcagttcatcttctcaccatgaggcctccctgctacacgcctccgtggggctgactaatcgctcgtggtactaccgtgactcaggtggagtatatgagtatcgaccagacctccactctctcttcgtcccgtaccacccgtggaccacggcccggtccctaccacctccgtccgtcgactaacgtactacgtacgacggacgtccgtacggtgactaagtaggtagaagtaacggaaactacctagttagttacgttaccgtgtaccnggaacacggacgtcgcggaccctactccaccacgtactactagttacttacgtacgttacgttacgtaggttacgtttaggttggacgtcgagacgacgtagtcgtagaggacggtcggtacggtacggtacggagtactacgttacgtactaacgtaacgaacgtacggttacgggacggggtcggagggtcgtacggtagggtagttacggtttggtagttatttaacttttagttatacgtaaggtactaacgggtttactaaagttcggtacgttcggttacttttacgggtaccggttacgggtaccgtaaccgtccttacggaccgttaactaataccggttaaacg

SEQ ID NO: 105397 - DNA, 640 bp, Homo sapiens
  misc_feature: GYAE6OF01D6J6F.29.71.G05.1.454.CMB.1.raw
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (291)..(291): a, c, t, g, unknown or other
  misc_feature (291)..(291): n is a, c, g, or t
tcagatagagtactcacgaccggtgctcgatttagtgtcgtcgcaagagagagggggtgatcaggacttctcagttcatcttctcaccatgaggctccctgctcagctcctgggctgctaatgctctggatacctggatccagtggagatattgagatgacccagacctccactctctctcgtccgtccaccccgtggacacgcccgcctccatcctcctgacaagtctagtcagcgtcctcgngacagtagngtagtaggaaactactatagttcgtacgttcggtaccngacgaaggtacgcgacgccacgtcccacgacgtactcgtattattagtacgtacttacgaagttgtttagttggactcgaccgtagacgaggtctacggagtacggcgagggtcggtacgaaggtactaagtacttacaacgtaagtaaacgaactcggacgggtacgggtagggacggtcggtaggaacggtgttcgggttagtaacgtttatttagttaacgttgtaacgtagttacgtaaacgttaacgttacgtacgttacgtttcgtttacggtttacggtttccggaaaccggttacgggtaaccctacgttacccgtaagtaaccgtaactaacggtaaacg

SEQ ID NO: 105398 - DNA, 683 bp, Homo sapiens
  misc_feature: GYAE6OF01EA6MH.29.71.G05.1.454.CMB.1.raw
  modified_base (436)..(436): a, c, t, g, unknown or other
  misc_feature (436)..(436): n is a, c, g, or t
tcagatagagtactcacgaccggtgctcgatttagtgtcgtcgcaagagagagggggactgatcaggacttctcagttcatcttctcaccatgaggctccctgctcagctcctgggctgctaatgctctggatacctggatccaggtggagatattgagtatgacccagacctccactctctctcgtcccgtcacccctggacacgcccggtcctccactcctctcgactaagtctaggtacagacgcctcgtgactataaggtcgaagttagggaaacgtaccttatagttacggttacgtacgggtacctggacgtaaggaacggtcgacggccctacgcccttacccgaacggtaccttaccttaggtaactttaagtacggttaacgtttaccgaagttcgttttagttttaggacgttcgacgtacgacgngtacgtacgaggtcgacgtacgggtccggtagacgggaactagtacttacgaaacgtacgtaagtaaaccgtcgtaacggggtacggtagggacgtagtaggaacggttgttacgttaggtaactttagttttaacgttagtacgtagtactaacggtaacgtaaactttgaccgttcttaggttcgtactttccggggaacgtaccggggtaactacgtaccggtacggtaaactaagtaaaccgg

SEQ ID NO: 105399 - DNA, 850 bp, Homo sapiens
  misc_feature: GYAE6OF01CTNEH.29.71.G05.1.454.CMB.1.raw
  modified_base (182)..(182): a, c, t, g, unknown or other
  misc_feature (182)..(182): n is a, c, g, or t
  modified_base (268)..(268): a, c, t, g, unknown or other
  misc_feature (268)..(268): n is a, c, g, or t
tcagatagagtactcacgaccggtgctcgatttagtgtcgtcgcaagagagagggggactgatcaggacttctcagttcatcttctcacatgaggctccctgctcagctccgtggggctgctaatgctctaggactacctggatccgaggtggagtatattggagtatcgaccagtactccnctctctctcgtcccgccaccccgtgaccgacgtcccggcctccatcctccagccgtaagttctaggtcacggacgtcccttcgtanacgattaaggtgaactaagggaaacgtaccttaaattacgtacgttaacgtacggtacctaggactaaacggtaacgtaccggaccggacccacgtaccccttacccggaaacccgttcccttaccggttaaggttttaaaccttttaaacggttaacggtttaaacccggttttacgtaaacccgggttttaggttttttaacgtttttaggggaccggtttaccgaaccccgttaagggacccgaacggggtttccctagggtacgggttacggggaccgtaaccgggggtaccgggttacgggaaacgggtaaaccggttaagtacgtttacccgaaacgtttaacgaaggtaaaccgttacggggacgggtacccggggtagggaacccgggtacgggagggttacgttcggttaacgggtacttttacgggtttattacgggtttcaacgtacgttaacgaaacgtttaaacgttcgacgtttacggttcgtttacccgtacgggtttccgggaccggtaaaccgggttacctaacgggttaccgtaacggttaaactccggtaaccgtaaaacggg

SEQ ID NO: 105400 - DNA, 934 bp, Homo sapiens
  misc_feature: GYAE6OF01DKO66.29.71.G05.1.454.CMB.1.raw
  modified_base (193)..(193): a, c, t, g, unknown or other
  misc_feature (193)..(193): n is a, c, g, or t
  modified_base (916)..(916): a, c, t, g, unknown or other
  misc_feature (916)..(916): n is a, c, g, or t
tcagatagagtactcacgaccggtgctcgatttagtgtcgtcgcaagagagagggggtcaggctggaactgaggagcagggtgggggcacttctccctctaacactcctcccctgttgaagcttctttggtgacgggcgagctcgacggccctgagtgggtcgtaccttcgcgaggtcgtagtactttggttntttctcgtagttctgtctttgcctcgagcgtcgagggtgtcgtcgcgtcggaggtcgttggtacggtcgtccgtttcgttcccgtttagacgttaacgttcgtacgtttaccggtacgggtaacctttacccggtaggtaaccgttaccgggttaaaggttacgggtaagttaagtttaaggtacggtaaagtacccgttaacccgggaaaccccgtaaccgttaccccttacccgttaccctttcctttacccggttccggttccccggttaccccccgtttacccgaacccccggttacgaaacccccggtcccggtccccgtacccttaccgttacccttaccccgtttcgacgtaaccgtaacggtttaccgttacgaccccgaggttacccgtccgttacggttaccgtaagttcgttaaggttaaccggaaacgggttaaaaccggttaacgtaacgtttaacgtttacggtaaccggtttacggtacccggttacgtacgtaaaccggtaacgtaccgggtaaccgaacccgtaccccgtacccgttaccccgttaaccggtaacccgtacgttttaccgttagttaacgtttaccgttaaagtttaccccgttaaacggttaaccggtttaggttttaccgggttagtacccggtaccggaacgtaccggtacgttacccggtactcggggtaacgtacggcgggtaaaccgggngggtaacccgggtaaagg

SEQ ID NO: 105401 - DNA, 790 bp, Homo sapiens
  misc_feature: GYAE6OF01BGX2T.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgagtgggtgacttcgcaggcgtagtactttgtgtttctcgtagtctgtctttgctcgagtcgtcgtagggtcgctgcgtggacgctggtaggtcgcgttcgttccgttgtacctaagtcggtcttcgtacggtaaccgtacgtacggtactaccgtaaggtagggtaacgtaagttaagttacggaagtacgttaccgtaaaccccgtaaggtaacccttaccctaccgttccttaccgttcccgttaccgtccccggtaccccgtaaccccggtacggtaacccgtccgggtacccccggtaccctacccgtaactttccccgtacgtaccggtaaccgttaaccggttacgtaacgtaccgaacggtaccgtaccgtcgtaccgtaacgtaacgttacggaaggttaacggtaaggtaaaccttactaaggtaacgtacgtacggttaccggtatacggaacgtaacggtcgtaaccggccgtaccacccggttctaaccgtaaccgttacttacggtaacgttatttaacgtaccgttaacgtttacggtaagttacggttttggtacggtacgtaccgtcggaaacggtcgtccggtactggtacggtcggtaacggtcgggacccgggtagaaccggg

SEQ ID NO: 105402 - DNA, 773 bp, Homo sapiens
  misc_feature: GYAE6OF01D8ARL.29.71.G05.1.454.CMB.1.raw
  modified_base (216)..(216): a, c, t, g, unknown or other
  misc_feature (216)..(216): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtggacgggcgagctcaggccctgatgggtgacttcgcaggcgtagtactttgtcgtttctcgtagtctgtctttgctcagcgtcagggtnctgctggaggtcgtgtaggtctctcgttccttgactaatgtctcgtaggtactaccgtaggtactcgaggtggagtattagttagaagtacgtaccgaaccacgacctacctaccttcctccttccgttccgttccccgtaccccttaccccgttcgaccgtaccggccccggtccctacccgtacttcccgtcctaccgaactaacgttccgtacgtcgacgtacccgtccgttcggtacgtacttagttaacggtacggtaacggtaaacgggtaaaccgtaaccgttaagttaacgttacggtttaacggttccggttaaccgtcggaacgtaaacggtaaccgtacggaaccggtaccgtaacccgtcccgtaacccgtaacccgtaccgtttaccgtaacgttttaaacgtttacggtttaacgttaaccggttttaccgttaaaggttttaccggtttaggtttaacgggtacggtcgtaaccgtaacggaccgtacgggtacctacggtacgggtacgggtacggacggggttccgggacgggtaaccgg

SEQ ID NO: 105403 - DNA, 781 bp, Homo sapiens
  misc_feature: GYAE6OF01CS67G.29.71.G05.1.454.CMB.1.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagatagagtactcacgaccggtgctcgatttagtgtcgtcgcaagagagagggggactgatcaggacttctcagttcatcttctcaccatgagcctccctgctcagctccgtgggctgctaatgctcgtggacttaccgtggactccgaggtaggagattataggagtagtcgaacccagtacctaccctactccttctctacgtccgccacccgtgaccgcgcccgcctcactctcngactagttctagnacgcgtcctacggtnacttagtaggtagtataaacggaactacttagtagttacgtacggttcgtaccgtcgacgaagtaacgccgaccggtactcgtacccgttacaccttacgtacttagtactttacggtaacggttaaccgtttaccgtaggttttacggttttaggtttacggacggttaccgaacggaacgtaccgaccggttctaacgggtaacggtcgggtaacggtacggggtaccggaaccggggtagtaaacccgttaggtttacccttaaccgaaacggtttacgttaacgggaaacgttccggcggggtacccggggtaggttacgggtaggtagggtacgttcgggtaacgggttgtttaaccgttgtttaattcggtagtcgttaacgttacgtttaaaagttaccgttacggtcgttttaccggttccgtttacgggtttacccgttaccgggtaccggttaccggggttaacctacggttccggtaaacgtaccgttaaaccggtaacggg

SEQ ID NO: 105404 - DNA, 810 bp, Homo sapiens
  misc_feature: GYAE6OF01AZWFP.29.71.G05.1.454.CMB.1.raw
tcagatagagtactcacgaccggtgctcgatttagtgtcgtcgcaagagagaggggggactgatcaggacttctcagttcatcttctcaccatgaggctccctgctcagcctcctggggctgctaatgctctggatacctggatccaggtggagatattgagatcgacccagacctccactctctctcgtcctccaccccgtggaccacggcccgcctccactcctcctgctaacgtcttagtcagacgtccgtcgtcgactagtaggtgaagtaacggaaacgaaccttatagtacgttaccgtcggtaacctgacgtaaggacgtaccgaacggccaccggtccctacccgaaccgtaccttaccgttagttaatttacgttaacggttaaaccgtttacccgtaaaggtttccgttttaagttttcgggaacgttcgaacccaacggtacgaaccggtcgtacggtcgggttacggaccgggacgggtaccggggtacggtaacggggaacgttacggttaacctttacgaaaccttaagtaaacggaaaaccgtcgggtaacccgggtccggggggtaacgggtacgggttacggggttaagggtcggggttaaggttaccggggttacggtttaacgttttaagtttttagttttaacggttaggttaaccgttaagttaccggtaaacggtttaaaacgttacgttacggttacggttttagttaaccggtttaccgggtttacggtaccgggtaccggtaacccgttacggtacccggtaaggtacccgttaaggtaaacccg

SEQ ID NO: 105405 - DNA, 901 bp, Homo sapiens
  misc_feature: GYAE6OF01AE9E2.29.71.G05.1.454.CMB.1.raw
  modified_base (210)..(210): a, c, t, g, unknown or other
  misc_feature (210)..(210): n is a, c, g, or t
  modified_base (258)..(258): a, c, t, g, unknown or other
  misc_feature (258)..(258): n is a, c, g, or t
tcagatagagtactcacgaccggtgctcgatttagtgtcgtcgcaagagagagggggtgatcaggacttctcagttcatcttctcaccatgaggctccctgctcagctccgtggggctgactaatgctctggactacctggactccaggtggagatattggagatcgaacccagaccttaccactctctctgtcccgtcacccgtggacncgtccgcctccatctcctgacctaagtccagtacagacgcctggtacncgtaagtacgtacgacgtacgggtaaactaccttagtacttacggttaccttcggggtaacccgtcggtacgtaacgggtaacgttaccggaacgggtacccctaacggtaccccgtacccgtaaccggtaaccctttccggtaagggtttaatttaacggttacggttaaacgtttaccgtaaacgggtttcgtttaaacggttttcgggaccggttacgaccccgaaggtacccgacgggttaccgtacggtaacgggttgaccgggtacgggtacgggttacggaaacggtactagggttaacctttacaaccgttaacgtaaacgtaaacctcggtaacccgtaccgggtagggtacggaacggggtacttaggggaaacggggttctacggggtttaacgtacgttttaaacgtttttaaacgttccgggttaacgtaccgttaaaacgggttacggtttaaacccgtaaaaccgggttttaccgaccggttttttaacgggttacccgggtttttaaccccggttttaaagggttttaccccccggggtaaacgggtaaaaccccggggtttacccctaacgggttttaacccccttaaaggggtaacccctttaaaaaccccggggtaaaacccgg

SEQ ID NO: 105406 - DNA, 694 bp, Homo sapiens
  misc_feature: GYAE6OF01BYB31.29.71.G05.1.454.CMB.1.raw
  modified_base (198)..(198): a, c, t, g, unknown or other
  misc_feature (198)..(198): n is a, c, g, or t
tcagatagagtactcacgaccggtgctcgatttagtgtcgtcgcaagagagagggggtgatcaggacttctcagttcatcttctcacatgagctccctgctcagctccgtggggctgctaatgctctggatacctggatcagtggagatatgagatcgaccagacctccactctctctcgtccgtccacccgtggacncggccgcctccactcctcgtgactaacgttctagtcaggacgtcctcggtgacagttagagtaagtaggaaaactacttatagtacggtacttcggtacctgacgaagtaacgcgacggaccacgcctaccacgtaccttcgtagttaatttagtaacgttaacgttacgtaacggttcgtttaaggtttacggagtacgacaacggtacgacggtcgtaccggtaggtcgggacgacgggtcgggtacggacggaacgtaagttacttacgtaacgtaacgtaaagtaaacgtaacggtacgggtacggggtacgggtacggtacggtaggtaacgggtaggttaggttacggttacgtttaacgttttaacgtttagttagtacgtagtaacgtaacgttaaacgttacgtcgttaaaaaacgttcgttacgtttacggttcggtaccggtaacggtaccgtacgtacgtacgaactaacgtaaacgtaaacgg

SEQ ID NO: 105407 - DNA, 728 bp, Homo sapiens
  misc_feature: GYAE6OF01DVM7A.29.71.G05.1.454.CMB.1.raw
  modified_base (126)..(126): a, c, t, g, unknown or other
  misc_feature (126)..(126): n is a, c, g, or t
  modified_base (252)..(252): a, c, t, g, unknown or other
  misc_feature (252)..(252): n is a, c, g, or t
  modified_base (704)..(704): a, c, t, g, unknown or other
  misc_feature (704)..(704): n is a, c, g, or t
tcagatagagtactcacgaccggtgctcgatttagtgtcgtcgcaagagagagggggtcaggctggaactgaggagcaggtggggcacttctccctctaacactctcccctgttgaagctctttgngacgggcgagcctcacggccctgagtgggtgtaccttcgcgaaggtcgtagtacgttttggttgttttcgtcgttagtctgtctttgctcgagtcgtcgagggtgcgtgcgtgagtcgtagtggtncgttcgtccttgactagtgcttcgtaggtactaccgtggactccgtaggtagtagtagttagttgagtacgtacgaccctacgtaccctaccgtacttccgttaccttccgttacgtcccccgtaccccgaccccgtcggaacccgtcccggtacccggtccctaccgtacctcccgtacctacggaactaacgttacgtaacgtcgacgtacgtccgttcgacgtaacgtagtaagtaccgtaaggtaaacgaacgttaaccttagttacggttaacgtaccggtttacgtacgtacgtaacgtaagtaccgcccgaggtacccgacccgtccgaacccgtacgacccgtttcttaagttacgtttaacgtacggttaccgttaacgtcggtttatttacgggttcgacgtaaccggactaacggcgtaccggagttacggcggttacggnggtacggcgggttaagaaacccgg

SEQ ID NO: 105408 - DNA, 701 bp, Homo sapiens
  misc_feature: GYAE6OF01D2RXW.29.71.G05.1.454.CMB.1.raw
  modified_base (115)..(115): a, c, t, g, unknown or other
  misc_feature (115)..(115): n is a, c, g, or t
  modified_base (125)..(125): a, c, t, g, unknown or other
  misc_feature (125)..(125): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
tcagatagagtactcacgaccggtgctcgatttagtgtcgtcgcaagagagagggggactgatcaggacttctcagttcatcttctcaccagtgaggcctccctgctcagctcgngggctgctangctcgtaggactaccgtggactcgaggtggagtattagtgaggactcgaacccagacctacctacctctcctacgtccgtccgtcccacccgtgaccnccgcccgcctccactcctccgnactactcgtacgngacgccgtccgtcgtgacgtagtagtagagtaacgaaacgtaactagtacgtaccgttacggtaccggtacaggaacgtaacggtacgtaccggaccgtccgtacccgacccgtaccgaacccgttaccgttacgttagttaatttacgttaacgttaacgttaccggttaagttacgttttagtcggactacggacaggtacgtcgtcgtcgaggtcggaccggtcggtacggacgggtagtacgtagttactacgaactaacggaagtaaggaccgggtagggtaccgggaggaacggtgtaggtaacggtgttacggtattacgttatttagtagtacgtagtataaaccgttaagttaacgtggttcgttacgtttacgttacgggtttcgaacggtccgtaaccgtcgttaacagggtaccctaagtaccggtaaacg

SEQ ID NO: 105409 - DNA, 935 bp, Homo sapiens
  misc_feature: GYAE6OF01D3J1C.29.71.G05.1.454.CMB.1.raw
  modified_base (209)..(209): a, c, t, g, unknown or other
  misc_feature (209)..(209): n is a, c, g, or t
tcagatagagtactcacgaccggtgctcgatttagtgtcgtcgcaagagagaggggggtgatcaggacttctcagttcatcttctcaccatgaggctccctgctcagctccgtggggctgctaatgctcgtggatacctggatccgaggtggagattattgagatcgaccacgtacctccactctctctcgtccgtccacccgtggacncgccggcctcctactcctccgtgacgtaagttctagtacgagacgtccgtcggtacactaagttagtagtaaggtaacgggaaaactacttaattacgttcgttacgtttacggtacctggacgaaaggtacgtacggacggaccacgtccctaccgtacggtaccttccgtatttaatttacgtaaggttaacgttaccgtaggtttagttttacggttagggaccgttacgacgtaacggtacgtcggtaccgttacggtaaggggtacgggaccgggtaacggggtaccggggtaacggtaaccggggtaacgttaacggtttaaacccgtttaacggaaaccgttaaaaccggttaaacgtaaaaccgggttccgggggtaaacccggggggttaacccggggggtgggggttaaaccggggttttaggggtaaacggggtaaaggggggttttaccggtttttaagggggtttaaccggtttaaacggttttttaagttttttttaaaggtttacggttaccgtttaacgttaacggtttaaaccggttaaaaccggtttttaaacgtttaccgggtaacgtttacccgttttttacggttaccgggtttttaaacccggggttcccggggggtaacccggttaacccggggttaacctttaacccggttacccgggttaaaggaacccgttttaaaccggaaaaacgggttaaccccggg

SEQ ID NO: 105410 - DNA, 684 bp, Homo sapiens
  misc_feature: GYAE6OF01DST08.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtgggctgctaatgctctggactaccgtggactccgaggtggagatattgagatcgaccagacctccactctctctcgtcccgtccacccgtggaccacggcccgtcctcctactcctcctgactaagtctagtcagtacgtcctcggtcgactagtacgtagtagtaacggaaactaccttatacgttacggtacgtacggtaccgtgacgtaaggaacgtcgacgacctacgtcccaccgtacgtcctcttagttattagtacgtaactttacgaagttcgtttaggtttggacgtcgaacgacgtacggcgtctacggtaggtcgacggtcgggtcgggtacggaaggactaagttactacgaacgtaacgtaagaaacgtcggaacggggtcgggtacgggagttcgggtaaggtacggttagttcggtacgttaaattttagtttaagttacgttaggactttaaggtaacgttaacgttaaacgtttcgacggttttcgttacgtttacggttcccggtttcggaacccggtacgtcctacggtacttacgaacctagtaaaaccg

SEQ ID NO: 105411 - DNA, 531 bp, Homo sapiens
  misc_feature: GYAE6OF02IHD2L.29.71.G05.1.454.CMB.1.raw
  modified_base (315)..(315): a, c, t, g, unknown or other
  misc_feature (315)..(315): n is a, c, g, or t
tcagatagagtactcacgaccggtgctcgatttagtgtcgtcgcaagagagagggggtgatcaggacttctcagttcatcttctcaccatgaggctccctgctcagcctccgtggggctgctaatgctctggatacctggatccagtggagatattgagatgacccagactccactctctctgtccgtcacccctggacagccggcctccatctcctgccaagtctagtcagagcctcgtgcatagtgatggaaagacctatatgtactggtacctgcagaagtcaggccagccctccacgactcctgtatttangtaagtttccaagtcgtttatttggagtgccagacaggctcaggtggcaggcgggtcgagggacagtatttacacactagaaaatcgaaggccggggtggaggcgtggaggatggttggctattttattattgctatgacgtaaagtttacagtcgttgttctacgttttcggaccgtaggggtacctacgtcccgtaggactactactaaaccgg

SEQ ID NO: 105412 - DNA, 518 bp, Homo sapiens
  misc_feature: GYAE6OF02IQ5R0.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaagtcgtttattttggagttgccagacaggctcagtggcaggcgggtcagggacagtatttcacactagaaatcaggccgggtggaggctggaggatggttggctatttattagttgctatgactaagtttacagtcttagttctacgttttcggacccgtaggggtacctacgttccgtaggacctagtaaccg

SEQ ID NO: 105413 - DNA, 500 bp, Homo sapiens
  misc_feature: GYAE6OF02IYFWQ.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagcctatatgtactggtacctgcagaagtcaggccagcctccacgactcctgatttatgaagtttccaagtcgttattttggagtgccagacaggctcagtggcagcgggtcagggacagatttcacactagaaatcaggccggtggagctgaggatgtggctatttatattgctatgactaagtttacagtcttagttctaacgttttggaccgtaggggtacctagttccgtaggtacataaccg

SEQ ID NO: 105414 - DNA, 499 bp, Homo sapiens
  misc_feature: GYAE6OF02IW0ZS.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcaccctggacagccgcctcatctcctgcaagtctagtcagagcctcgtgcatagtgatggaaagacctatatgtactggtacctgcagaagtcaggccagcctccacgactcctgtatttatgtaacgtttccaagtcgtttattttggagtcgccagacaggctacaggttggcaggcgggtacaacgggg

SEQ ID NO: 105415 - DNA, 520 bp, Homo sapiens
  misc_feature: GYAE6OF02G9RYP.29.71.G05.1.454.CMB.1.raw
  modified_base (309)..(309): a, c, t, g, unknown or other
  misc_feature (309)..(309): n is a, c, g, or t
tcagatagagtactcacgaccggtgctcgatttagtgtcgtcgcaagagagagggggtgatcaggacttctcagttcatcttctcaccatgaggctccctgctcacgctcctggggctgctaatgctctggatacctggatccagtggagatattgagatgacccagactccactctctctgtccgtcaccctggacagccggcctccatctcctgcaagtctagtcagagcctcgtgcatagtgatggaaagcctatatgtactggtacctgcagaagtcaggccagcctccacgactcctgatttangaagtttccaagtcgttatttggagtgccagacaggctcaggtcgcagcgggtcgagggacaggactttcacacgtagaaatcgaaggccgggtggaggcgtagaggatggtaggctagtttattagttgctatgacgtaagtttacagtacgttgttactacgtttcggaccgtagggacctacgtcctacggtactacgtactaaaccg

SEQ ID NO: 105416 - DNA, 532 bp, Homo sapiens
  misc_feature: GYAE6OF02HMQYW.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaagtcgtttagttttggagtgccagacaggctcagtggcaggcgggtacgagggacagtatttcaactactagaaatcgaggccgggtaggaggtctaggaggtagttggttggactagtttattagttgactagtgactaagtttacagtcttgttctacgttttcggaccgtaacggggtacctacgttccgtaggacctataaccg

SEQ ID NO: 105417 - DNA, 516 bp, Homo sapiens
  misc_feature: GYAE6OF02GS2HR.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgttatttggagtgccagacaggctcagtggcagcggtcagggacagatttcacactagaaatcagccgggtggaggcgtgaggagtgttggctagtttattattgctagtgactaaagtttacagtcgttgttctacgtttttcggaccgtaggggtaccgtacgttccgttaggacctatacgtaaaccgg

SEQ ID NO: 105418 - DNA, 516 bp, Homo sapiens
  misc_feature: GYAE6OF02IEO10.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttangtaagtttccaagtcgttatttggagttgccagacaggctcagtggcagcgggtcgagggacagtatttcacactagaaaatcgacggccgggtggaggcgtggaggagtggttggctatttattagttgcatgactaagttactagtcgtgttctacgttttcggaccgtagggacctacgtccgtaggactacgtactaaacgg

SEQ ID NO: 105419 - DNA, 512 bp, Homo sapiens
  misc_feature: GYAE6OF02H4FPG.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcacaatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttangaagtttccaagtcgttatttggatgcagacaggctcagtggcagcgggtcagggacagattcacactagaaaatcagccgggtggaggcgtggaggtagtggttggctatttattagttgctatgactaaagtttacagtcttgttcctacgttttggaccgtagggtacctacgtcccgtaggactacgtagtaaaccgg

SEQ ID NO: 105420 - DNA, 506 bp, Homo sapiens
  misc_feature: GYAE6OF02GKORV.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgttattttggagtgccagacaggctcagtggcagcgggtcagggacagatttcacactagaaatcagccgggtggaggctgaggatggttggctatttattattgctatgtactaagtttacagtcttgtttctacgttttggccgtaggggtaccctagttcccgtaggtacataaccg

SEQ ID NO: 105421 - DNA, 491 bp, Homo sapiens
  misc_feature: GYAE6OF02HXNAL.29.71.G05.1.454.CMB.1.raw
  modified_base (486)..(486): a, c, t, g, unknown or other
  misc_feature (486)..(486): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgttattttggagtgccagacaggctcagtggcaggcgggtnacggg

SEQ ID NO: 105422 - DNA, 519 bp, Homo sapiens
  misc_feature: GYAE6OF02GNNG4.29.71.G05.1.454.CMB.1.raw
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttangtaagtttccaagtcgtttattttggagtgccagacaggctcagtggcagcgggtnagggacagatttcacactagaaaatcgaagccgggtggaggctggaggatggttggctagtttattagttgctagtgactaaagtttacagtcgttgttctacgttttggaccgtaggggtaccacgttcccgtggtactagtactaaaccgg

SEQ ID NO: 105423 - DNA, 528 bp, Homo sapiens
  misc_feature: GYAE6OF02GZDPI.29.71.G05.1.454.CMB.1.raw
  modified_base (212)..(212): a, c, t, g, unknown or other
  misc_feature (212)..(212): n is a, c, g, or t
  modified_base (358)..(358): a, c, t, g, unknown or other
  misc_feature (358)..(358): n is a, c, g, or t
  modified_base (522)..(522): a, c, t, g, unknown or other
  misc_feature (522)..(522): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtccttgctaatgctctggatcctggatccagtggagatattgagatgacccagacctccactctctctgtccgtcaccctggacagccggcctccatcctctgctaagtctagtcagagcctcgngcattagtgatggaaatcctatatgtactggtacctgacagagtcaggccagcctccacgtactccgtgtactttacgtgtaacgtttccgaagtcgtttagtttgggacgttcgacctaggaccgtacggccttacgacggtacggaccgtaggtccgggtanaacggg

SEQ ID NO: 105424 - DNA, 518 bp, Homo sapiens
  misc_feature: GYAE6OF02I3EGL.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaaggccagcctcacgactcctgatttangtaaatttccaagtcgtttatttaggagtcgccaagacaggctcgagtggcgagcggtcgagggacagattcacactagaaatacgagccgggtaggaggcgtgaggagtggttaggctatttagttagttgactatgactaagttacagtactgttactacgtttggaccgtagggtacctacgtccgtaggactagtacgtaaacg

SEQ ID NO: 105425 - DNA, 500 bp, Homo sapiens
  misc_feature: GYAE6OF02IMLPH.29.71.G05.1.454.CMB.1.raw
  modified_base (309)..(309): a, c, t, g, unknown or other
  misc_feature (309)..(309): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagcctatatgtactggtacctgcagaagtcaggccagcctccacgactcctgatttangaatttccaagtcgttatttggagtgccagacaggctcagtggcagcgggtcagggacagatttcacactagaaatcaggccgggtggaggctgaggatgttggctatttattattgctatgactaaagtttacagtctgttctacgttttggccgtagggtacctacgtccgtaggactatactaaacgg

SEQ ID NO: 105426 - DNA, 530 bp, Homo sapiens
  misc_feature: GYAE6OF02IU9ON.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccgcctccatctcctgcaagtctagtcagagcctcgtgcatagtgatggaaagacctatatgtactggtacctgcagaagtcaggccagcctccacgactcctgtatttangtaagtttccaagtcgtttatttggagtgcctagacaggctcaggtcggcaggcgggtcgagggacagtattcaactactagaaatcgaggccgggtaggaggcgtggaggagtggttggctagtttagtttattgctatagactaaagtttacagtcttgttacttacgttttcggaccgtacgggacctacgttccgtaggacgtatacgtaaaccgg

SEQ ID NO: 105427 - DNA, 519 bp, Homo sapiens
  misc_feature: GYAE6OF02IR6WC.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccgcctccatctcctgcaagtctagtcagagcctcgtgcatagtgatggaaagacctatatgtactggtacctgcagaagtcaggccagcctccacgactcctgatttatgtaagtttccaaagtcgttattttggagtgcagacaggctcagtggcagcgggtcgagggacagtatttcacactagaaaatcgagccgggtggaggctggaggatggttggactagttttaattatttgactagtgactaagtttacaggtcttagttactacgttttcggccgtacggggtacctatacccgtaggtacagtaacg

SEQ ID NO: 105428 - DNA, 520 bp, Homo sapiens
  misc_feature: GYAE6OF02F5MZ0.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgttattttggagtgccagacaggctcagtgcaggcggtcgagggacagatttcacactagaaaatcgagccgggtggaggcgtaggaggagtggttggactagttttagttagttgctagtgtactaagtttacagtcttgttacgtacgttttcggaccgtaggggtacctagttccgtaggactagtaaccg

SEQ ID NO: 105429 - DNA, 518 bp, Homo sapiens
  misc_feature: GYAE6OF02IQAU8.29.71.G05.1.454.CMB.1.raw
  modified_base (424)..(424): a, c, t, g, unknown or other
  misc_feature (424)..(424): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgttcatagtgatggaagacctatatgtactggtacctgcagagtcaggccagcctccacgactcctgtatttatgaacgtttccaagtcgtttattttggagtgccagacaggctcaggtggcaggcggtcgagggacagactttcacactgaaaatcaggccgggtggaggctgaggatggttggntatttattattgactatgactaagtttacagtctgtttactacgttttggaccgtaaggggtacccagttcccgtaggactagtactaaaccgg

SEQ ID NO: 105430 - DNA, 515 bp, Homo sapiens
  misc_feature: GYAE6OF02HFPK6.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaaagtcgtttaattttggagtgccagacaggctcagtggcagcgggtcagggacagatttcacactagaaatcgagccgggtggaggctaggaggtagtgttggactatttattattgctagtgactaagtttacagtcttgttctacgttttcggaccgtacggggacctagttcccgtaggtactataacg

SEQ ID NO: 105431 - DNA, 522 bp, Homo sapiens
  misc_feature: GYAE6OF02G4RXC.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttangtaagtttccaagtcgttattttggagtgccagacaggctcgagtggcaggcgggtcgagggacagtatttcacactagaaaatcgaaggccgggtggaggcgtggaggatggttggctattttagttattgctatgactaaagtttacagtcgtgttacttacgtttggaccgtaggggtacctagtcccgtaggacctatacgtaaacgg

SEQ ID NO: 105432 - DNA, 513 bp, Homo sapiens
  misc_feature: GYAE6OF02IPTJ7.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaagtcgttattttggagtgccagacaggctcagtggcaggcgggtcagggacagtatttcacactagaaatcgaggccgggtggagcgtaggaggtagtggttgctatttattattgctatgactaaagtttacagtcttgttactacgttttcggccgtagggacctacgtccgtaggactagtactaaacg

SEQ ID NO: 105433 - DNA, 604 bp, Homo sapiens
  misc_feature: GYAE6OF02JJDD2.29.71.G05.1.454.CMB.1.raw
  modified_base (315)..(315): a, c, t, g, unknown or other
  misc_feature (315)..(315): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgatggaaagctatatgtactggtacctgacagaagtcaggccagcctccacgactcctagtactttanagtaacgtttccaaagttcgtttagttttggagttcgaccgtagacctagggcctacgaggtcggcgacggtcgggtacgacggggactaggtactttcgaactaacgtagaaaactcgacgggccgggtgggaaggcgtaggaagggtattggttggacttaagtttagtttagttcggtactaagtcgtaacgttaagtttaacgaggttactttagttacgttaacggttttcgggaccgtaacggggttaccctaacgttcccggtacggtacctaactaaccgg

SEQ ID NO: 105434 - DNA, 526 bp, Homo sapiens
  misc_feature: GYAE6OF02HWIXC.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatagtaacgttttccaaaggtcgtttaatttttggaagttgaccagacaggctcaggtggcgaggcgggtcgagggacagtatttcacactagaaaatcgaggccgggtggaggctggaggtatggttgctagtttattagttgactatgactaagtttacagtcttgttctacgttttcggccgtaggggacctagtcccgtaggactataaccg

SEQ ID NO: 105435 - DNA, 559 bp, Homo sapiens
  misc_feature: GYAE6OF02GWT2W.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgacagaagtcaggccagcctccacgacctcctgtatttatagtaagtttccaagtcgtttagttttggagttgaccagacaggctcgagtggcaggcgggtcgagggacagtattacactactagaaaactcgaggccgggtagggacggcgtaggaggtagttggttggtacttagttttattagttgtactaagtgtacgtaagtttacgagtcttacgttacttacgttttacggaccggtaacggggtacctacgttacccgtacggactataacccgg

SEQ ID NO: 105436 - DNA, 832 bp, Homo sapiens
  misc_feature: GYAE6OF02FFXLF.29.71.G05.1.454.CMB.1.raw
  modified_base (201)..(201): a, c, t, g, unknown or other
  misc_feature (201)..(201): n is a, c, g, or t
tcagatagagtactcacgaccggtgctcgatttagtgtcgtcgcaagagagagggggactgatcaggacttctcagttcatcttctcaccatgaggctccctgctcagctcctgggctgctaatgctctggatacctggatccagtggagatattgagatgacccgatcctccactctctcgtcgtccgtccaccgtgacnccggccgtcctacactcctcgtgacgtaagtcgtacgtcacgcgtccgtcgtgactagttagacgtaaggtaacggtaaacctaccttaagttacgttacgtacggttacgttaccgtgaacgtaaggtacctaccggaccggtacctaccgtcccctaaccgtaccgttaccgtttccgtaagtttaacgttttaacgtaacggtttaaccgttaccgtaacggttttacggtttttaaggttcggaaccggtccgaaccgtaacggtaacccggtacggtccgttaacgggtacgggtaccgggaacggtaccgggggtaccggttacggaaacggggttaacttaaccgtttaacctttaaacccgaaacgtaaacgttaaaaacggtaaccggtacgggtaacccggggggttacggggtaacggtaaccggggttacgtaaggggtttaacgggtttaccgttttaggggttacccgttaaaatttttttacgttttaagtttacgacttaaacggttagttaccgtaaaagtttttaccgacgttacggtttacgtttcggttaaccgtttcgggtaccggacggttaaccggtcctacgttacggactaactaacgtaaaccgg

SEQ ID NO: 105437 - DNA, 510 bp, Homo sapiens
  misc_feature: GYAE6OF02HE98G.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagttccaagtcgtttattttggagtgccagacaggctcagtggcaggcgggtcagggacagtatttcacactagaaatcgaggccgggtggaggcgtggaggattggttggctatttattattgctagtgactaagtttcagtcttgttactacgttttggccgtaggggacctagtccgtaggactagtaaccg

SEQ ID NO: 105438 - DNA, 522 bp, Homo sapiens
  misc_feature: GYAE6OF02F7CH6.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaagtcgtttattttggagtgccagacaggctcagtgcgagcgggtcgagggacagtattcacactagaaatcgaggcgggtggaggtctaggaggtagtggttaggctatttattagttgctagtgtacgtaagtttacgagtcttgtttactacgttttcggaccgtacggggacctacgtccgtacggactataaccg

SEQ ID NO: 105439 - DNA, 508 bp, Homo sapiens
  misc_feature: GYAE6OF02HFQRH.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacagccggcctccatctctgcagtctagtcagacgcctcgtgcatagtgataggaaagacctatatgtactggtacctgcagagtcagccagcctccacgactcctgtatttatagtaacgtttccaagttcgtttagttttggagttcgaccagacgaggctcgaggtggacgacggtcgggtcgaacggg

SEQ ID NO: 105440 - DNA, 549 bp, Homo sapiens
  misc_feature: GYAE6OF02IGUOW.29.71.G05.1.454.CMB.1.raw
  modified_base (359)..(359): a, c, t, g, unknown or other
  misc_feature (359)..(359): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcagccagcctcacgactcctgatttatgtaagtttccaagtcgtttattttggagtgcagacaggctgagtggcgnggcggtcgagggacagtatttcacactagaaaatcgaggcgggtaggacggcgtagggaggtagttggttacgggcttaagttttaagtttagtttggactagttagtacttaaaggtttactagtctttagttacttacgttttcgggaccgtacggggtacctacgttcccgtaggtactataaccgg

SEQ ID NO: 105441 - DNA, 515 bp, Homo sapiens
  misc_feature: GYAE6OF02H8SVM.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgtttattttggagttgccagacaggctcagtggcaggcgggtcgagggacagatttcacactagaaaatcagccgggtggaggctggaggattggttggcgtatttattattgcagtgactaagtttacagtcttgttctacgttttcggaccgtaggggacctagttcccgtaggtacctataacccg

SEQ ID NO: 105442 - DNA, 559 bp, Homo sapiens
  misc_feature: GYAE6OF02GM6CF.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgaataggaaagacctatatgtactggtacctgacagaagtcaggccagcctccacgacctccgtgtatttatgtaacgtttccaagtcgtttattttggagttcgaccgagacgaggtctacgaggtggcaggcgggtacgagggacagtattcactactagaaactcgaggtccgggtggaggcgtaggaggtagtggttaggcttagttttattagttgactagtacgtacgtaaagtttacagtccttagttacgttacgttttcggaccggtacggggtacctagttacccgtaggtactagttaaccg

SEQ ID NO: 105443 - DNA, 478 bp, Homo sapiens
  misc_feature: GYAE6OF02HO3MY.29.71.G05.1.454.CMB.1.raw
  modified_base (308)..(308): a, c, t, g, unknown or other
  misc_feature (308)..(308): n is a, c, g, or t
tcagatagagtactcacgaccggtgctcgatttagtgtcgtcgcaagagagaggggctgatcaggacttctcagttcatcttctcaccatgaggctccctgctcagctcctggggctgctaatgctctggatacctggatccagtggagatattgagatgacccagactccactctctctgtccgtcaccctggacagccggcctccatctcctgcaagtctagtcagagcctcgtgcatagtgatggaaagacctatatgtactggtacctgcagaagtcaggccagcctcacgactcctgatttangaagttccaagcgttattttggatgccagacaggctcagtgcagcggtcagggacagattcacactagaaaatcagccggtgaggctgagagtgttgcatttattattgcatgacaagtttacagtctgttctactttggaccaggggaccagttcctggacagtaaccg

SEQ ID NO: 105444 - DNA, 605 bp, Homo sapiens
  misc_feature: GYAE6OF02F6N8M.29.71.G05.1.454.CMB.1.raw
  modified_base (315)..(315): a, c, t, g, unknown or other
  misc_feature (315)..(315): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagacgcctcgtgcatagtgataggaaagacctatatgtactggtacctgcagaagtcaggccagcctccacgacctcctgtatttangtaacgtttccaagtcgtttatttggagtgccagacaggctacgagtggcaggcgggtcgagggacagtactttacactaacgtagaaaactcgaacggtccggggtagggacggtcgtaggagggtagttgggttaggtactttaagtttttaattagtttacggactaagttacggtaacgttaaagttttacgacggttacgttggttttaccgttacggtttttccgggaccggtacggggtaaccctacgttacccgtagggtaacctacgtaaccgtaaaccgg

SEQ ID NO: 105445 - DNA, 550 bp, Homo sapiens
  misc_feature: GYAE6OF02GFL5C.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgacctcctgtatttatgtaacgtttaccaagtcgtttagttttggagttcgccagacgaggctcgagtggcaggcgggtcaggggacagtattcactactagaaatcgaggccggggtaggaggcgtaggaggattggttaggtcttatttagttagttggactagtgtaactaacgtttacagtacttgttacttacgttttacggaccgtaaggggtacctacgttccgtaggtactacgtacgtaaaccgg

SEQ ID NO: 105446 - DNA, 532 bp, Homo sapiens
  misc_feature: GYAE6OF02IYWFO.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgtaagtttccaagtcgtttattttggagtgccagacaggctcgagtggcgagcgggtcgagggacagtatttcactactagaaattcgaggccgggtaggacggctggaggtagtggttggactagttttagttatttgactatgactaagtttacagtcttcgttcttacgtttcggaccgtacggggtacctacgttccgtaggtacctagtaaccg

SEQ ID NO: 105447 - DNA, 630 bp, Homo sapiens
  misc_feature: GYAE6OF02I8XIZ.29.71.G05.1.454.CMB.1.raw
  modified_base (314)..(314): a, c, t, g, unknown or other
  misc_feature (314)..(314): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacagccggcctccatctcctgcaagtctagtcagacgcctcgtgcatagtgataggaaagacctatatgtactggtacctgcagaagtcaggccagcctaccacgactcctgtatttagntaacgtttccaaagtcgtttattttcgggagttcgaccgaagacgaggtctacgaggtcggcgaggccgggtacgagggaccgtagtactttacgaactacgtaagtaaaactcgtaaggaccgggttaggacggtacgtaggtaagggtacgttaggtttacggtacgttaagttttaagtttaagttgtacgtaagttcgtaacgtaaagttttacgaagttacgttggtttaccttacggttttaccgggaccggttaacggggtaacccttacggttacccgtaaggtaccgtaacgtaacgtaaaacccgg

SEQ ID NO: 105448 - DNA, 545 bp, Homo sapiens
  misc_feature: GYAE6OF02HJOK4.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgcagaagtcaggccagcctccacgacctcctgtatttatagtaacgtttccaaggtcgtttagttttggagttcgaccagacaggctacgagtcggcgaggcgggtacgagggacagtattcacactagaaatcgaggcgggtggaggctaggaggtagtggttacggcttaagttttagttagttgactagtcgaacttaagtttacagtcgttagttacgtacgttttcggacgtacggggacctacgttccgtaggactataaccg

SEQ ID NO: 105449 - DNA, 520 bp, Homo sapiens
  misc_feature: GYAE6OF02GVNK2.29.71.G05.1.454.CMB.1.raw
  modified_base (353)..(353): a, c, t, g, unknown or other
  misc_feature (353)..(353): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatgaagtttcaagtcgtttattttggagtgccagacaggctnagtggcaggcgggtcaggggacagtatttcactactagaaatcgacggccgggtggaggtctggaggagtggttggtactattttattagttgctatgactaagtttacagtcttagttctacgttttggaccgtacgggtacctactccgtaggtaccagtaaccg

SEQ ID NO: 105450 - DNA, 574 bp, Homo sapiens
  misc_feature: GYAE6OF02HW8GU.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgacagaagtcaggccacgcctccacgactcctagtatttatgtaacgtttccaagtcgtttattttgggagttcgaccagacaggctacgaggtggcaggcgggtacaaggggacagtatttacaactactagaaaatcgacggtccgggtaggaggcgtagggaggtagttggttagggtacttaagttttaagttagttgactagtgtaactaaagttttacaggttcgttagtttaccttacggttttcggaccgtacgggtacctacgtcccgtaggtaactacgtacgtaaaccgg

SEQ ID NO: 105451 - DNA, 734 bp, Homo sapiens
  misc_feature: GYAE6OF02F8G59.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtcttgctcagcgtcgagggtgctgctggaggtctggtaggtgtctcgttccttgactaagtgctcgtggacttaccgtggactccgtaggtggaagtattagttaggaagtagtacgaacccgaacgtacctaccctaaccttccttccttcgttccgtacccgtaccctacccccgtacgggaaccgaccggtccccggcccttacccgacttcccgttcccgtcggactaaacgttcgttaacgtaccgaaggtaccgtccgttcggtcgactaagtacgggtagaacgtaacgggaaaacgtaccttaagttacgttacgttaaccggttacggtaaccttggaacgtaaggtaacgtacgacggtaccacgtcccctaccgaaccggtacctccgttagttaacttttagtaacggttaacgtttaaccgaacggtttcgttttacgtttagggacgttcggaaccccgtaaggtaaccgtacggtccttacggtaacggttccgggacgtacggggtaccggggtacgaaaccgggg

SEQ ID NO: 105452 - DNA, 505 bp, Homo sapiens
  misc_feature: GYAE6OF02GTZDM.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaaagtcgttattttggagtgccagacaggctcagtggcagcgggtcagggacagtatttcacactagaaatcagccgggtaggaggctggaggatggttggctatttattattgcatgataaagtttacagtcttgttactacgtttggaccgtaggggacctagtcctaggactatacgaaacg

SEQ ID NO: 105453 - DNA, 498 bp, Homo sapiens
  misc_feature: GYAE6OF02GBKFH.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagcgttattttggagtgccagacaggctcagtggcagcgggtcagggacagatttcacactgaaatcagccgggtggaggcgtggaggtagtgttgggctagttttattattgctatgctaagttacagtctgttctacttttggccgtaggggtaccagttcctgtacataaccg

SEQ ID NO: 105454 - DNA, 539 bp, Homo sapiens
  misc_feature: GYAE6OF02F6F07.29.71.G05.1.454.CMB.1.raw
  modified_base (315)..(315): a, c, t, g, unknown or other
  misc_feature (315)..(315): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgcagaagtcaggccagcctccacgacctcctgtatttangtaagtttccaagtcgtttattttggagttgcagacaggctcgagtggcaggcggtcgagggacagtatttacacactagaaatcgaggccgggtggaggcgtaggaggtagttggttggtcttaagttttacgttagttgactagtcgtaactaagtttacgagtcgttagtttactacgttttggaccgtagggtacctacgtccgtacggactagtaaccg

SEQ ID NO: 105455 - DNA, 649 bp, Homo sapiens
  misc_feature: GYAE6OF02JBNTR.29.71.G05.1.454.CMB.1.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagacctccactctctctgtccgtcaccctggacncgccggcctccatcctcctcgctaagtctagtcagacgcctcgtcnctagtagtgagtagggaaacgaccttaattactagttacgttacggttaccctggactaaggtaaacgttaccgacgggacccaacggccccttacccgaaccgtaccctttcccgttaggtaactttttaacgttaggttaaaccgttttacccgtaaaggttaccggttttacgttttttaggggaacgtttcgggtaacccgtaacgggtaaccgtacgggtaccgttacgtaacgggttaccgggaccggtaacgggtaccggggttaccggaacggggg

SEQ ID NO: 105456 - DNA, 588 bp, Homo sapiens
  misc_feature: GYAE6OF02H91EV.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacacgccggcctccatctcctgcaagtctagtcagacgcctcgtgcatagtgatggaaagacctatatgtactggtacctgcagaagtcaggccagcctcacgactcctgatttatgtaagtttccaagtcgtttaattttgggagttgacctagacaggcctgaggtcggcaggccgggtcgaggggactaggtatttcacaactagaaaactcgaacggtccggggtagggaggcgtagggagggtagttgggttggtacgttaattttaagttagtttagtcgtagtagtacgttaaagttttacgtacgtcgtttacgtttacgttacgtttttcgggccggtaacggggtacctacgttccgtacgggaactacgtacgtaaaaccgg

SEQ ID NO: 105457 - DNA, 595 bp, Homo sapiens
  misc_feature: GYAE6OF02F13H0.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgatggaaagacctatatgtactggtacctgcagaagtcaggccagccctcacgactcctgtatttatgtaacgtttaccaagtcgtttattttggagttcgccagacaggtctcgagtcggcgacggcgggtcgagggactagtacttacactaacgtagaaaactcgaacgggccggggttaggacggtcgtaggaagggtagttggttaggtactagttttaatttacgttgtactagttacgtacgttaaacgttttacgacgttcgtttacgttaccttaacggttttcggaccgtaacggggaccttacggttaccgttagggtaccttacgtacgtaaacccgg

SEQ ID NO: 105458 - DNA, 524 bp, Homo sapiens
  misc_feature: GYAE6OF02GRYH1.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaagtcgtttattttggagtgccagacaggctcagtgcagcgggtcgagggacagatttcacactagaaaatcgagccgggtggacggctggaggtagtggttaggctagttttattagttgctagtgacgtaaagtttacagtcgttgttcttacgtttggccgtaaggggacctagttcccgtaggactacgtactaaaccgg

SEQ ID NO: 105459 - DNA, 529 bp, Homo sapiens
  misc_feature: GYAE6OF02F3PP1.29.71.G05.1.454.CMB.1.raw
  modified_base (253)..(253): a, c, t, g, unknown or other
  misc_feature (253)..(253): n is a, c, g, or t
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
  modified_base (422)..(422): a, c, t, g, unknown or other
  misc_feature (422)..(422): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaanacctatatgtactggtacctgcagaagtcaggccagccctccacgacctcctgtatttagngtaagtttccaagtcgtttatttgggatgccagacnggctcgagtgcagcgggtcgagggacagtattcactactagaaatcgaggccgggtggaggtcgtagaggtnttggttggtactagtttattattgactagtagtactaagttacagcgttcgttctacggtttcggaccgtagggtacctagttccgtaggactacgtacgtaaacgg

SEQ ID NO: 105460 - DNA, 512 bp, Homo sapiens
  misc_feature: GYAE6OF02GKZSS.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctcgtccgtccacccctggacagccggcctccatctcctgcaagtctagtcagacgcctcgtgcatagtgataggaaagacctatatgtactggtacctgcagaacgtcaggccagcctccacgacctcctgtatttatgtaacgtttccaagtcgtttagtttggagtcggaccaggacaggctacgaggtggcagggtccgggtgaacggg

SEQ ID NO: 105461 - DNA, 553 bp, Homo sapiens
  misc_feature: GYAE6OF02IRL3L.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgtatttatagtaacgtttccaaaggtcgtttaagttttggagttgaccagacagggcctcgaggtcggcgacggcggggtacgacgggacagtatttcaactactagaaattcgaggccgggtaggaggcgtggaggtagtggttggtactagttttattagttgctagtagtactaagtttacagtcttagttacgtacgttttcggaccgtaaggggtacctacgttaccgtaggtacagtaaccg

SEQ ID NO: 105462 - DNA, 544 bp, Homo sapiens
  misc_feature: GYAE6OF02HWR83.29.71.G05.1.454.CMB.1.raw
tcagatagagtactcacgaccggtgctcgatttagtgtcgtcgcaagagagagggggaatgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcagtctagtcagagcctcgtgcatagtgataggaaagacctatatgtacttggtacctgcgagaagtcaggccagccctccacgactcctagtatttatagtaagtttaccaagtcgtttagttttgagtcgccagacaggctcgagtggcaggcgggtacagggacagtattacactactagaaatcgacggccgggtggaggcgtaggaggtagttaggtgacttagtttattagttgactatagacttaagtttacaggtcttagttactacgttttcggaccgtacggggtacctacgttaccgtaggtaccgtagtaaccg

SEQ ID NO: 105463 - DNA, 576 bp, Homo sapiens
  misc_feature: GYAE6OF02IX2AR.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccgcctccatctcctgcaagtctagtcagagcctcgtgcatagtgatggaaagacctatatgtactggtacctgcagaagtcaggccagcctccacgactcctgtatttatgtaagtttccaagtcgtttattttggagtgaccagacagggctcgagtggcaggcgggtcagggacagtatttcactacgtagaaaacttcgacggtccggggtagggaggccgtagggagggtaagttgggttgggacttaagttttagtttagtttggctaagttgtaaccttaaagtttacgtaggtctttcggttaccttacgtttttacgggacccggtacggggtaccctagttcccggtacggtactacgtaaaccg

SEQ ID NO: 105464 - DNA, 533 bp, Homo sapiens
  misc_feature: GYAE6OF02GMH2Y.29.71.G05.1.454.CMB.1.raw
  modified_base (319)..(319): a, c, t, g, unknown or other
  misc_feature (319)..(319): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggcccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtcctcacccctggacncgccgcctccatctcctgcaagtctagtcagcgcctcgtcgcatagtgataggaaacacctaatatgtactcggtacctgacagaagtcgaggccacgcctaccacgtacctctagtatttatagtaacgtttaccaagtcgttttagtttggagttcggacctaggaccgagggtcctacgacggttggaccgtaggccgggtacgaacgggg

SEQ ID NO: 105465 - DNA, 638 bp, Homo sapiens
  misc_feature: GYAE6OF02IALWT.29.71.G05.1.454.CMB.1.raw
tcagatagagtactcacgaccggtgctcgatttagtgtcgtcgcaagagagaggggtgatcaggacttctcagttcatcttctcaccatgaggctccctgctcagctcctggggctgctaatgctctggatacctggatccagtggagatattgagatgacccagactccactctctctgtccgtcaccctggacagccgcctccatctcctgcaagtctagtcagagcctcgtgcatagtgagtggaaagtacctatatgtactggtacctgacagagtcagccagccctcacgactcctagtattatagtaactttccgaaagtcgtttagtttggagttcgaccgtagaactagggtctacgaggttcggcgaggtccgggtacgaacgggtacagtacgtttacaacgtaacgtagaaaactcgaacgggtccgggtaggacggtcgtaggaacgggtagttgggttaggtacgttaagtttttaagttagtttcgacgtaagttacggtaaccgtttaaacgtttacgtaacggttacgtttacggtttaccgttacggttttcgggaacccggtaacggggtaaccctacggttacccgttacgggtaaccttaccggtaaccgtaaaccgg

SEQ ID NO: 105466 - DNA, 505 bp, Homo sapiens
  misc_feature: GYAE6OF02FL9PD.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagcccggcctccatctcctgcaagtctagtcagagcctcgtgcatagtgatggaaagacctatatgtactggtacctgcagaagtcaggccagcctccacgactcctgatttatgaagtttccaagcgtttattttggagtgccagacaggctcagtggcagcgggtcagggacagtattcacactagaaatcagccgggtggaggctgaggatgtaggctatttatattgcatgactaaagtttcagtcttgttactacgttttggaccgtaaggggtacctactaccgtgacgtatactaaaccgg

SEQ ID NO: 105467 - DNA, 538 bp, Homo sapiens
  misc_feature: GYAE6OF02F46TY.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagagtcaggccagcctccacgactcctgtatttatgaagtttccaagtcgtttattttggagtgccagacaggctcagtggcagcggtcagggacagtattcactactagaaatcgaaggccgggtaggaggtcgtggaaggtataggttggactagtttatttattgactagtgacgtaagtttacgagtcgttagtttacgtacgtttttcggaccgtacggggtaccctacgttcccgtacgggtacctagtaacccg

SEQ ID NO: 105468 - DNA, 733 bp, Homo sapiens
  misc_feature: GYAE6OF02HT7ED.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagacctccactctctctgtccgtcacccctggacagccggcctccatctcctgcaagtctagtcagagcctcgtgcatagtgatggaaagacctatatgtactggtacctgcagaagtcaggccagcctcacgactcctgatttatgtagtttccaagtcgtttatttggagtgacctagacagggtctacgaggttcggacgaggtacggggttacgaacgggggaaccgtaaggttaacgttttaccgaaacctaaccgttaaggaaaaaacgttccggaaacgggtaccccgggggttaaggggtaacggggtaccggttacggggtaagggtaacggtttcggggttttaggggtaccgttaagtttttaagttttaaacgttttagggtaccttaaagttacgtaaccgtttaaaaacggtttttaaccgtaacggttaccggtttacggtttttacccgttaaaccggtttttttacccggggacccggttaaaccgggggggtaaccccttaaacggttcccccggtttaaggggtacccgttaaacgttaaaccccggg

SEQ ID NO: 105469 - DNA, 613 bp, Homo sapiens
  misc_feature: GYAE6OF02G5V1Q.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgattatgtaagtttccaagtcgttatttggagtcgccgagacgaggctacagtggcacggcgggtacgagggacgagtatttacacgactaagtaaaagtcgacgggaccgggttaggacggcgtaggagggtagttggttggacttaagtttttaagttacgtttagccttagtacgtaacgttaaacggttttacgacgttaccgtttacggtttaccgttaacggtttttaccgggacccggttaacggggtaacccttaccggttacccgttacgggtaaccgtaccgttaaccgtaaaacccggg

SEQ ID NO: 105470 - DNA, 526 bp, Homo sapiens
  misc_feature: GYAE6OF02FGFZB.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccgcctcatctcctgcaagtctagtcagagcctcgtgcatagtgatggaaagacctatatgtactggtacctgcagaagtcaggccagcctccacgactcctgatttatgtaagtttccaagtcgtttattttggagtgaccagacaggctcgaggtcggcgaggcgggtcgagggacagtatttcacactagaaatcgaggccgggtggacggcgtaggaggtagtggttggtactagttttattattgctatgactaagttacagtcttgttactacgttttcggaccgtacgggtacctacgtccgtaggtactagtaaccg

SEQ ID NO: 105471 - DNA, 682 bp, Homo sapiens
  misc_feature: GYAE6OF02I2VDC.29.71.G05.1.454.CMB.1.raw
  modified_base (319)..(319): a, c, t, g, unknown or other
  misc_feature (319)..(319): n is a, c, g, or t
tcagatagagtactcacgaccggtgctcgatttagtgtcgtcgcaagagagaggggacgtgatcaggacttctcagttcatcttctcaccatgaggctccctgctcagctcctgggctgctaatgctctggatacctggatccagtggagatattgagatgacccagactccactctctctgtccgtcacccctggacacgccggcctccatcctcctcgcaagtctagtcagcgcctcgtgcatagtgataggaaagacctatatgtaactggtacctgcagaagtcaggcctagccctccacgacctctcgatttanacgtaagttcccaagtcgtttaatttttcgggaaagtcgtacccgtaagtaccgtaacgggtcttaccgtaagggttcgggaccgtaacggtaccggggtaccggaaggggtaacccgtagggtaactttttaccgggaacctaaccgtttaggaaaaaacgtttccgaaacgggtacccggggttagggaacgggtacgttaccgggaagggtacggttagtttacggggacttaaggttttaacgtttagtttacgtacgtaagttaggtactaagtttaacgtacgtcgttaagtttccgtaacgttttcggtaccgtacggggtactacggttaccgtcggtaacgtacgtaaacccgg

SEQ ID NO: 105472 - DNA, 556 bp, Homo sapiens
  misc_feature: GYAE6OF02H3N8U.29.71.G05.1.454.CMB.1.raw
  modified_base (211)..(211): a, c, t, g, unknown or other
  misc_feature (211)..(211): n is a, c, g, or t
  modified_base (379)..(379): a, c, t, g, unknown or other
  misc_feature (379)..(379): n is a, c, g, or t
tcagatagagtactcacgaccggtgctcgatttagtgtcgtcgcaagagagaggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtccttgctaatgctctggataccgtggatccagtggagatattgagtatcgacccagacctccacttctctctcgtccgtccaccccgtggaccacgcccggtcctccacttcctcctgacctaagtctagtcaagacgccctcgtncatagtgataggaaacacctatatagtacgtggtacctgcagagtcgagccacgcctccacgtacctcctagtactttagtcgttaacgttaccgtagttacgtttagtttcgggacgttcggacctagaccgtaggccgttcgacggtcggtaccgagggtccgggtacgaacggg

SEQ ID NO: 105473 - DNA, 586 bp, Homo sapiens
  misc_feature: GYAE6OF02HCYC2.29.71.G05.1.454.CMB.1.raw
  modified_base (310)..(310): a, c, t, g, unknown or other
  misc_feature (310)..(310): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacagccggcctccatctcctgcaagtctagtcagagcctcgtgcatagtgatggaaagacctatatgtactggtacctgcagaagtcaggccagcctccacgactcctgtatttangtaacgtttccaaggtcgtttaattttgggagttgaccagacagggtcctcgaggtcggcgaggcggggtcaggggactaggtatttccgaacactagaaaactcgaacggtccggggtaggacggctaggaggtagttggttcggacttagttttaattagtttgacctagtacgtacttaaaggtttaccagttacgttgttacttacggttttcgggacccggtaaggggttaccctacgttccggtacggtaacctagtaccgtaaaaccgg

SEQ ID NO: 105474 - DNA, 530 bp, Homo sapiens
  misc_feature: GYAE6OF02GXB5H.29.71.G05.1.454.CMB.1.raw
tcagatagagtactcacgaccggtgctcgatttagtgtcgtcgcaagagagaggggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaagtcgtttattttggagttgccagacaggctcgagtggcaggcgggtcgagggacagtattcacactagaaatcgaggccgggtggaggcgtaggaggtagtggttggctaagttttattattgctagtgtactaagtttacagtcttcgtttctacgttttcggaccgtacggggtacctacgttccgtacggtactagtaaccg

SEQ ID NO: 105475 - DNA, 701 bp, Homo sapiens
  misc_feature: GYAE6OF02JODLD.29.71.G05.1.454.CMB.1.raw
  modified_base (258)..(258): a, c, t, g, unknown or other
  misc_feature (258)..(258): n is a, c, g, or t
  modified_base (314)..(314): a, c, t, g, unknown or other
  misc_feature (314)..(314): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacagccggcctcatctctgcaagtctagtcagacgcctcgtgcatagtcataggaaagacctanatgtactggtaacctgacagagtcaggcctagccctacgacgactcctgtatttanagtaacgtttccaaacgtcgtttaacgttttgggaacgttgacccgtaagtaaccgagggtcctttacgacgggtttagggccgtaagggtccggggtacgaacggggtaccgtaagtaacgtttaccgaaacgtaaccgttaacggtaaaaactcccggtaacgggtaccccggggttagggacgggtaccgttagggaaaggttacgttagggtttagggaccgtttattttaagtttagttacgtacgtaaggttacgtaacgttaaacggtttacgtacgtacggtttacggtttaccttacggtttttaccgggacccgtaaggggttacccgtacgttacccggttaagtaaccccggttaacgtacccgtaaaaaccggg

SEQ ID NO: 105476 - DNA, 510 bp, Homo sapiens
  misc_feature: GYAE6OF02GDN9C.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccccctggacagccggcctccatctcctgcaagtctagtcagagcctcgtgcatagtgatggaaagacctatatgtactggtacctgcagaagtcaggccagcctccacgactcctgatttatgtaagtttccaagtcgtttattttggagtgaccagacaggctcgagtggcaggcgggtcagggacagtattcacactagaaatcgaggccgggtggaggctgaggattggttggactatttattagttgcatgactaagtttacagtcttgttactacgtttggaccgtagggtaccagtcctaggactatactaaacg

SEQ ID NO: 105477 - DNA, 574 bp, Homo sapiens
  misc_feature: GYAE6OF02ITI9F.29.71.G05.1.454.CMB.1.raw
  modified_base (259)..(259): a, c, t, g, unknown or other
  misc_feature (259)..(259): n is a, c, g, or t
tcagatagagtactcacgaccggtgctcgatttagtgtcgtcgcaagagagaggggggactgatcaggacttctcagttcatcttctcaccatgaggctccctgctcagctcctggggctgctaatgctctggatacctggatccagtggagatattgagatgacccagactccactctctctgtcccgtcacccctggacagcccggcctccatctcctgcaagtctagtcagacgcctcgtgcatagtgatggaaanacctatatgtactggtactgacagaagtcaggccagcctccacgactcctgtattagtgtaacgttccaagtcgtttattttggagttcgaccagacgaggtctcgagtggcgaggcgggtacgagggacagtactttacacacgtaagaaactcgaagggccgggtaggacggcgtaggaggattggttaggtacttagttttattagttgtactaagtgtattaaacgtttactaggtcttacggtttacgtaccgttttacgggaccggtaacggggtaccttacggtaccgttacggtactacgtaaccgg

SEQ ID NO: 105478 - DNA, 636 bp, Homo sapiens
  misc_feature: GYAE6OF02FPGKD.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaagacctatatgtactggtacctgcagaagtcaggccagcctccacgactcctgtattatagtaagtttccaagtgttattttggagttcgaccagacaggctcgagtcggcgaggccgggtcgaaggggacaaggtactttaccactacgtaagaaaactcgaacggtcccgggggtaggacgggtcgtagggtaagggtagtttggttacgggtacttaagtttttaagttttattacggtacgtaaacgttggtaaccgtttaaaaggttttaccgaaggttaccgtttaggtttacccgttaaccggtttttccggaacccggtaacgggggttaccctacgttaccggtacggtaaccctaagtaacccgtaaaaccgg

SEQ ID NO: 105479 - DNA, 619 bp, Homo sapiens
  misc_feature: GYAE6OF02GHLCX.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagccctccacgactcctgatttatgtaagtttccaagtcgtttattttgggagttgccagacaggctcgagtggcgaggcgggtcgagggacagtactttcaactactaagaaaacgtcaacgggccggggttaggacgggtcgtaggaagggagttggttagggacttaagtttttaagtttagtttagaccgtagttacgtaacctaaaggttttacgtaacggtcgtttacggttttaccttaaccggtttttacgggtacccggtaacgggggtaccccttaacggttacccgttacgggaaccttaacgttaaccgtaaaacccggg

SEQ ID NO: 105480 - DNA, 589 bp, Homo sapiens
  misc_feature: GYAE6OF02HQL15.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctcgtccgtccacccctggacagcccggcctccatctcctgacaagtctagtcagacgcctcgtgcatagtgagtaggaaacgacctatatgtactggtacctgcagaagtcaggccagccctacacgcctctgtatttagtagtaacgtttcaagtcgtttagtttggagtcgaccagacgaggtctacgaggtcggcgacggcgggtacgaagggacagtactttacactacgtagaaactcgacggaccgggtaggaggtcgtagggaggtagttggttaggtacttaagttttaagtttagttacgtactagttacgtaacgttaaagtttacgacggttcgttacgtttacttacgttttacggaccgtacgggtacctacgttccgtaggtacctagtaaccg

SEQ ID NO: 105481 - DNA, 585 bp, Homo sapiens
  misc_feature: GYAE6OF02GVQNU.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggactccagtggagatattgagatgacccagactccactctctctgtccgtccacccctggaccacgccggcctccatcctcctgcaagtctagtcagacgcctcgtgcatagtgaataggaaaagtacctaatattgtaactcggtacctggaccaaggtaacgtcgacgggcccaacggccccttaccgaaccggtacctccgttaggtaacttttaataggtaaacgttttaccgaagttccgttttagttttcgggaaggttcgacccgtaagtaccgtagggtcctacgtagggtccgacggacgggtccgggtagaacgggg

SEQ ID NO: 105482 - DNA, 527 bp, Homo sapiens
  misc_feature: GYAE6OF02HI290.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtacctgcagaagtcaggccagcctccacgactcctgatttatagtaagtttccaagtcgtttattttggagtgccagacaggctcgagtggcaggcgggtcagggacagtatttacactactagaaaatcgacggccgggtggaggctaggaggatggttggcttattttattattgctatgtactaagtttacagtcttgttcttacgttttcggaccgtacggggacctagttcccgtaggtacctagtaaccg

SEQ ID NO: 105483 - DNA, 511 bp, Homo sapiens
  misc_feature: GYAE6OF02HALXR.29.71.G05.1.454.CMB.1.raw
  modified_base (312)..(312): a, c, t, g, unknown or other
  misc_feature (312)..(312): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctcacgactcctgtatttangtaagtttccaagtcgtttattttggagttgccagacaggctcgagtggcaggcggtcgagggacagtattcacactagaaatcagccgggtgagtctagaggatggttgctatttagttattgctagtgactaagtttacaggtcttgttctacgttttcggaccgtacgggtacctacgtccgtagacctataaccg

SEQ ID NO: 105484 - DNA, 581 bp, Homo sapiens
  misc_feature: GYAE6OF02JIY9B.29.71.G05.1.454.CMB.1.raw
  modified_base (315)..(315): a, c, t, g, unknown or other
  misc_feature (315)..(315): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcagtagtgaataggaaacgcctatatgtactggtacctgcagaagtcaggccagcctaccacgactcctgtattangtaacgtttccgaagtcgtttatttggagtcgaccagacaggcctagaggtgacgaggtcgggtacgacgggactagtacttacactactaagtaaactcgaggaccgggtgggacggtcgtaggaggtagtggttacggtacttacgtttagttagttgtacgtatacgtacgtaaacgtttactagtacgttagttaccgttacgtttacggaccggtaacgggtaccgtacgtaccgtacggtaccgtagttaccgtaaacgg

SEQ ID NO: 105485 - DNA, 552 bp, Homo sapiens
  misc_feature: GYAE6OF02H9QVE.29.71.G05.1.454.CMB.1.raw
  modified_base (343)..(343): a, c, t, g, unknown or other
  misc_feature (343)..(343): n is a, c, g, or t
tcagatagagtactcacgaccggtgctcgatttagtgtcgtcgcaagagagaggggtgatcaggacttctcagttcatcttctcaccatgaggctccctgctcagctcctggggctgctaatgctctggatacctggatccagtggagatattgagatgacccagactccactctctctgtccgtcacccctggacagccgcctccatctcctgcaagtctagtcagagcctcgtgcatagtgatggaaagctatatgtactggtacctgcagaagtcaggccagcctccacgactcctgtattatgtaacgttccaagttcgttagttttggagttcgaccngacaggtctcgagtcggcgaggcgggtacgagggacagtatttacactacgtagaaaactcgaggtccgggtggacggtcgtaggaggtagttaggttaggtcttagttttattagttagtacagtagtacgtaaagtttacagttcgtgtttacctagtttcggaccgtaacgggtacctacgttccgtggaactacgtacgtaaacg

SEQ ID NO: 105486 - DNA, 570 bp, Homo sapiens
  misc_feature: GYAE6OF02IWG3A.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactgtacctgcagagtcaggccagcctccacgactctgtattatgtaagttccaagtcgttatttggagtgaccagacgaggtctcgaggtgcgaggcgggtacgagggacaagtacttacaactacgtaagaaaacgtcgaacggtccggggtaggaggtccgtaggaagggtattgggttacggacgttagttttaattagttagacgtagtcgtaacttaaaggtttacagttacgttgtttcgttaacgtttcggaccggtagggtacctacgttccgtaggtaacctataccggtaaacgg

SEQ ID NO: 105487 - DNA, 657 bp, Homo sapiens
  misc_feature: GYAE6OF02JKZSC.29.71.G05.1.454.CMB.1.raw
  modified_base (159)..(159): a, c, t, g, unknown or other
  misc_feature (159)..(159): n is a, c, g, or t
tcagatagagtactcacgaccggtgctcgatttagtgtcgtcgcaagagagagggggacgtgatcaggacttctcagttcatcttctcaccatgaggctccctgctcagctcctgggctgctaatgctctggatacctggatccagtggagatattganagtgacccagactccactctctctcgtccgtccaccccttgaccacgcccggccctccatcctcctgccaacggtctacggtcaggacgtccctcgtgccatagtgagtaggaaagaccttaagtatgtacttcggtacctgactagaacgtcgacggccacgcctccacgacctcctgtattatagtaacttaccaagtcgtttagttttggaagtcgtactaagtaccagtcgtactcgtagtcggacacgggtccgggtacggaacgggtacgtaaggtacgtttacgaaccgtacgttaaacgtaaacgtaccgtacgggaccgggtgggaacgggccggttaagggaaggtaggtttagggttacgggtacctttaaggtttttaagtaacgtttggaaccttagttacgtacgttaaagttcgtaacgtacgtttcgttacttacgttttacggaccggtacgggtaccttacgtaccgtggtacgtaaccg

SEQ ID NO: 105488 - DNA, 614 bp, Homo sapiens
  misc_feature: GYAE6OF02HKDL6.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaagacctatatgtactggtacctgcagaagtcgaggccagcctcacgactcctgtatttatgtaagttccaagtcgtttattttggagtgcctagacgaggctcagtggcaggcgggtcagggacagtatttcactaactagaaaactcgaaggcccggggttgggacggcgtacgggaaggtagttgggttacgggacgttaagttttaagtttaacgtttgtacgtaagttagtaacgttaaaggttttaaccgtaggttaccgtttacggtttaccgtttaaccgttttacgggtacccggtaacggggggtaaccctaccggtttacccggtaaggtacccgtaacttaaacccgg

SEQ ID NO: 105489 - DNA, 610 bp, Homo sapiens
  misc_feature: GYAE6OF02F7U33.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctcgtccgtcacccctggacacgccggcctccactctcctgcaagtctagtcagacgccctgtcgacattagtagatagggaaaacgtaccttaattagtacgtaccgttacggtaacctggacaaggtaacgttacacggggcccaacggtcccctaccgaaccggtaccttcccgtagttaacttttaacgtacggttaaacgttttcccgaaggttccgtttttaggttttgggacggttcgtacccgaaggtacccgaggtccttacgtagggttccggacgacggggtccgggttacgaacggggg

SEQ ID NO: 105490 - DNA, 566 bp, Homo sapiens
  misc_feature: GYAE6OF02GIB8L.29.71.G05.1.454.CMB.1.raw
  modified_base (314)..(314): a, c, t, g, unknown or other
  misc_feature (314)..(314): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaagacctatatgtactggtacctgcagaagtcaggccagcctccacgactcctgatttangtaatttccaagtcgtttattttggagttgaccagacaggctcagtggcaggcgggtcagggacagtattcaacactagaaatcgagggtccgggtaggacggctagggaggtagttaggttggacttaagttttatttaagttcgtactaagttagtaccgttaaagtttccgaaggttcttacggttacttacgttttacgggaccggtaacggggtaccctacgttccgtagggtacctaagtaacccg

SEQ ID NO: 105491 - DNA, 559 bp, Homo sapiens
  misc_feature: GYAE6OF02HS6XM.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgattttatagtaacgtttccaaggttcgtttagttttggagtgaccaagaccaggctcgaggtcggcaggcgggtacgaggggacaggtactttacactaacgtagaaaagttcgaggcccgggtgggacggtcgtaggaggtagttggttggacttagtttagttattcgactagtgactaacgttttacgagtcttagtttctacgttttcggacgtacgggtacctacgttccgtacggtactagtaaccg

SEQ ID NO: 105492 - DNA, 622 bp, Homo sapiens
  misc_feature: GYAE6OF02HTMJD.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtcccgtcacccctggacagccggcctccatctcctgcaagtctagtcagagcctcgtgcatagtgatggaaagacctatatgtactgtacctgcagaagtcaggccagccctccacgactcctgtatttagtgtaacgtttccaagtctttagttttggagtcgaccgagacgaggtctcgaggtcggcgaggtcgggtacgagggacgagtactttacactacgtagaaactcgtacgggccgggtggacggtcgtaggaggtagttgggttcgtacgttaagttttagtttagttgtacgtaagttacgtaacgttaaacggtttacgtacggtctttacggttttaccttaaccggttttttacgggacccggttaaccgggggaaccccgttaacgttacccggtttaacggtaaccgtaccgttaaaaccccgg

SEQ ID NO: 105493 - DNA, 706 bp, Homo sapiens
  misc_feature: GYAE6OF02HSF0M.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacacgccgcctccatctcctgcaagtctagtcagagcctcgtgcaatagtgataggaaactacctatatgtacgtggtacctgacaaggaagtcacggaccacgtccctaccacgtaccttcctagtatttatacgtaactttccgaagttcgtttagttttgggagttcgaccgtaagtaacgacggtactccggtaggtcggacgtacgggtacggggttaccgaacggggtactaaggttactttaaccgaacgtaaccgtaaaggtaaaaccgttacggaacggggtacccggggttaggggacgggtacgtacgggaaaggttagttcgggttaggtacttttaagtttaagttttacgtacgttacgtaacgttacgttaacgttaaacgtttacgtacggtttcgtttaacgtttacccggttttaacgggtttccgggtaaccggtacggggtaaccttaccggttaccggttacggtaaccttaggtaacccgttaaaacggg

SEQ ID NO: 105494 - DNA, 577 bp, Homo sapiens
  misc_feature: GYAE6OF02ILXO9.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccgcctccatctcctgcaagtctagtcagacgcctcgtgcatagtgataggaaagacctatatgtactggtacctgcagaagtcaggccagcctccacgacctcctgtactttatggtaacgtttccaagttcgtttagtttgggagtgcctagacgaggtctcgaggtgcgaggcgggtcgaggggacaggtacttcaactacgtagaaactcgacggccgggtagagggctagggaggtagtggttggacgttattttagttagtttgacgtataggtacttaaaggtttactagtcgtttcggttccgttaacgttttccgggaccgtacgggtacctacgttccgttacggtaacctacgtaaccgtaaaccgg

SEQ ID NO: 105495 - DNA, 604 bp, Homo sapiens
  misc_feature: GYAE6OF02HMU06.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagacgcctcgtgcatagtgataggaaagacctatatgtactggtacctgcagaagtcaggccagcccaccacgacctcctagtatttagtagtaacgtttaccaagttcgtttattttgggagtcgaccagacgaggtctacgaggtcggacgagggcgggtacgaaggggactagtatttacaactacgtaagaaaactcgacggccggggttagggacggtcgtagggaggtacgttggttcggtacttaagttttagttagttcggactagttagtaacttaaaggtttacacgttcgttacggtttaccgttaacgttttcgggaccgtaacggggtacctacggttcccgtaaggtacctacgtaaaccg

SEQ ID NO: 105496 - DNA, 610 bp, Homo sapiens
  misc_feature: GYAE6OF02G3RVG.29.71.G05.1.454.CMB.1.raw
  modified_base (251)..(251): a, c, t, g, unknown or other
  misc_feature (251)..(251): n is a, c, g, or t
  modified_base (388)..(388): a, c, t, g, unknown or other
  misc_feature (388)..(388): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctcgtccgtccacccctggacacgcccggcctccatcctcctgcaagtctagtcagcgcctcgtgcatagngataggaaagacctatatgtactcggtacctgcaagaagtcgacggccacgtcctccgaacgtcctctgtatttatagtaacgttcaagtcgtttagtttaggacgtacgccgaagacaggtctacgaggtggacgnggacgggtacgagggacgagtactttcgaactacgtagaaaacttcggacgggcgggtaggacggctagggacggtgttaggttcggactttaagtttacgtttagttcggacttaaggtcgaacgttaaacggtttccaaggttcgtttacgttacgtttacggtttcgggaaccggttaacgggtaccaccggttaccgtagggacctagttaaacccgg

SEQ ID NO: 105497 - DNA, 559 bp, Homo sapiens
  misc_feature: GYAE6OF02GHXW8.29.71.G05.1.454.CMB.1.raw
  modified_base (313)..(313): a, c, t, g, unknown or other
  misc_feature (313)..(313): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgacagaagtcaggccagcctccacgactcctagtatttangtaagtttccaagtcgttattttgggagttcgaccagacaggtctacgagtgcgaggcgggtacgagggacagtactttcacgtactagaaactcgaggtccgggtagaggtacgtggaagggtagttggtacggtacttagttttaacttagttgactagtgtaactaagtttacagtcttaggttaccttacgtttacggccgtaagggtaccctaggtcccgtaggactacgtactaaaccgg

SEQ ID NO: 105498 - DNA, 602 bp, Homo sapiens
  misc_feature: GYAE6OF02H80J2.29.71.G05.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
tcagatagagtactcacgaccggtgctcgatttagtgtcgtcgcaagagagaggggtcgaggctggaactgaggagcaggtgggggcacttctccctctaacactctccctgttgaagctctttgtgacgggcgagctcaggccctgatgggtgacttcgcaggcgtagactttgtgtttctcgtagtctgcttgctcagcgtcagggtnctgctgaggctgtagtgctgtccttgctatcgctctggataccgtggactcgagtggagatgtagagatcgacccagactccactctcnctcgtaccgtccaccccgtgaacncgcccgtccnccatcctccctgaccaagtctacgtcgaaacgcgtcctcgtcgactaagtaggtcgaagttacgggaaaactaacccgttattaagtcggttaaccgtgggttaacccagaacgtaagaacgtaccgaacggcctaccgtacccctaacccgaacgtccgtacgttattaacgtttaacgttaacgtaaacgttaccgtaagtttcgtttagttacggacttgaccgagtaacgcgtctaggacggtacgacggacggtcggagaacgg

SEQ ID NO: 105499 - DNA, 590 bp, Homo sapiens
  misc_feature: GYAE6OF02JASMC.29.71.G05.1.454.CMB.1.raw
  modified_base (559)..(559): a, c, t, g, unknown or other
  misc_feature (559)..(559): n is a, c, g, or t
tcagatagagtactcacgaccggtgctcgatttagtgtcgtcgcaagagagagggggtcaggctggaactgaggagcaggtggggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccaggtggagtatattgagatcgaacccagacctccactctctctcgtccgtccaccccgtggaccacgcccggccctccactcctcctgactaacgttctagtcagacgtccgtcgtcgctagtagtagtaagtaaagaaacgtacctagttatacgtacgttcggtaccgtcgtacgaagtaacgtcgacggccaccgaccctcccaaccgtcctccgttagtattttagtacggttaacgtttaccgtagttacgttttagtttaggtagtcgaccgagacgtacggtctacgnggtccgacggtacgggtcgggtacgaacggg

SEQ ID NO: 105500 - DNA, 643 bp, Homo sapiens
  misc_feature: GYAE6OF02HE21X.29.71.G05.1.454.CMB.1.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
tcagatagagtactcacgaccggtgctcgatttagtgtcgtcgcaagagagagggggactgatcaggacctctcagttcatcttctcaccatgaggctccctgctcagctcctggggctgctaatgctctggatacctggatccagtggagatattgagatgacccagactccactctctctgtccgtcacccctggacacgccggcctccactctcctcgacagtctagtcagngcctcgtgcataggtnagtaggaaagacctatatgtactggtacctgcaagaagtcacggccacgcctaccacgtacctcctgtatttanagttaacgttaccaaggttcgtttagttttggagtcgccaagacgacgggtctagaggtcgacgtacgggcgggtacgaagggacagttactttcgaactaacgtaagtaaaacgtcgaacggggtaccgggtagggaacggtcgtagggtaacgggtacgttgggttcggtaacgtttaagttttagttacgttaggctaaggttacgttaacgttaaaacgtttctacggttcttacggtttaccttacggttttcggacccggttaacgggtacccttacggttacccggtaggttaacccgtagttaaacccgg

SEQ ID NO: 105501 - DNA, 647 bp, Homo sapiens
  misc_feature: GYAE6OF02HCQ1S.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctctcgcaagtctagtcagagcctcgtgcatagtgataggaaagacctatatgtacgtggtacctgcagagtcgaggccagcctaccacgacctcctgtattatagtaacgttccgaagtcgtttagtttggagtcgacgagacaggctacgaggtcggacgacggcgggtacgaagggtacagtactttacaactacgtaacgtaaactcggaacgggtccggggtagggacgggtacgtagggaacggtaggtttcgggttaggtaactttaagttttttaactttaggtttacggacttaagttaacggttaaccgttaaaaggtttttccgaacggtttcgtttaggttttacccgttacggtttttccggggaaccgtacggggttaacccctagttaccccggttaaggtacccgtaagttaaacccgg

SEQ ID NO: 105502 - DNA, 582 bp, Homo sapiens
  misc_feature: GYAE6OF02F7KJU.29.71.G05.1.454.CMB.1.raw
  modified_base (234)..(234): a, c, t, g, unknown or other
  misc_feature (234)..(234): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtccacccctggacagccggcctccatctcctgcaagtctagtcagancctcgtgcatagtgataggaaagacctatatgtactggtacctgcagaagtcgaggccagcctccacgctcctgtattatgtaacgttccaagtcgtttagttttggagtgccagacaggctcgaggtcggcgaggcgggtcgagggacaggtatttcgactactaagaaacttcgacggccgggtaggacggcgtaggacgggtagttggttaggtacttagttttagttagttggacttaagtcgtaacgttaaagtttactaggttctttacgtttacgttaacgttttcgggaccgtaacggggtacccttacgtacccgttcggtaccgtaagttaaacccgg

SEQ ID NO: 105503 - DNA, 573 bp, Homo sapiens
  misc_feature: GYAE6OF02HUYP9.29.71.G05.1.454.CMB.1.raw
  modified_base (326)..(326): a, c, t, g, unknown or other
  misc_feature (326)..(326): n is a, c, g, or t
  modified_base (377)..(377): a, c, t, g, unknown or other
  misc_feature (377)..(377): n is a, c, g, or t
tcagatagagtactcacgaccggtgctcgatttagtgtcgtcgcaagagagagggggtcaggctggaactgaggagcaggtgggggcacttctccctctaacactctccctgttgaagctctttgtgacgggcgagctcacggccctgatgggtgacttcgcaggcgtagactttgtgtttctcgtagtctgctttgctcagcgtcagggtgctgctgaggctgtaggtgctgtccttgctaatgctctggataccgtggatccgagtggagatattggagatcgacccagacctccactctctctcgtccgtcaccccgtggacngcccggcctcactctcctgcaagtctagtcagacgcctcgtgcatacgtanatacggaaacaccttatactgtactggtacctgacgagaacgtcaggaccacggcctaccgaccgtactccgttgtaactttagtagtaaacgtttccaaggttccgtttagttttcgggtagttacggaccgtaaggtacccgtaggtaccttcggtaggtacggacccggacgggtcccggggttagaacgggg

SEQ ID NO: 105504 - DNA, 500 bp, Homo sapiens
  misc_feature: GYAE6OF02GZOKZ.29.71.G05.1.454.CMB.1.raw
  modified_base (435)..(435): a, c, t, g, unknown or other
  misc_feature (435)..(435): n is a, c, g, or t
  modified_base (494)..(494): a, c, t, g, unknown or other
  misc_feature (494)..(494): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacagccggcctccatcctcctgcaagtctagtcagagcctcgtgcatagtgataggaaagacctatatgtactggtacctgcagagtcaggccagccctccacgactcctagtatttangtaactttaccgagtcgtttatttggagtcgaccagacagctcgaggtgcgaggcggtnaacggg

SEQ ID NO: 105505 - DNA, 561 bp, Homo sapiens
  misc_feature: GYAE6OF02FO6PY.29.71.G05.1.454.CMB.1.raw
  modified_base (311)..(311): a, c, t, g, unknown or other
  misc_feature (311)..(311): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagcccggcctccatctcctgcaagtctagtcagagcctcgtgcatagtgatggaaagcctatatgtactggtacctgcagaagtcaggccagcctccacgactcctgattttangaagtttccaagtcgttattttggagtgtccagtacaggctcgagtggcgagcgggtcagggacagtatttcgacactagaaatacgacgccggggtagacgggactggaggtagtaggttggtcgtaactttagtttaattgcaagtgtaacgtaaagtttacaagtcgttgtttaccttaccggttttcggacccggtaagggtaaccgtacgttacccgttaggaacgttacgtaccgtaaaaccgg

SEQ ID NO: 105506 - DNA, 733 bp, Homo sapiens
  misc_feature: GYAE6OF02JGSQ9.29.71.G05.1.454.CMB.1.raw
  modified_base (276)..(276): a, c, t, g, unknown or other
  misc_feature (276)..(276): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgatggaaagacctatatgtactggtaccngcagagtcaggccagcctccaccgactcctgtactttatagtaacgttttcccgaaaggttccgttttaagtttttgggaacgtttcggacccgtaaggtaaccgaacggggtaccctttacgaacgggttcggggaccgtaacgggtccgggggttaccgaacggggggaacctaagggtaaccttttaccaaccgtaaccgtaacggtaaaaacttccggaacgggtacccggggggttagggaacgggtaccgtagggtaacgggtacgttacggttacgggtacttaagtttttaacgtttaacgtttggtaccgttaagttcgggtaaaccttaaaggttttaaccacgggttaccgtttacggtttaccgttaacggttttttaccgggaacccggtaacgggggttaccctaacgttcccggttaacgggtaacctaacgttaaacccgg

SEQ ID NO: 105507 - DNA, 530 bp, Homo sapiens
  misc_feature: GYAE6OF02FYQI9.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaagtcgtttattttggagtgaccagacaggctcgagtggcaggcgggtcgagggacagtatttcactactagaaatcaggtccgggtaggaggtcgtaggaggtagtggttggacttattttagttattgactatagactaagttacagtcttgttactacgttttcggaccgtacgggtacctacgtccgtaggtacctagtaaccg

SEQ ID NO: 105508 - DNA, 615 bp, Homo sapiens
  misc_feature: GYAE6OF02G8YYO.29.71.G05.1.454.CMB.1.raw
  modified_base (313)..(313): a, c, t, g, unknown or other
  misc_feature (313)..(313): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgataggaaagacctatatgtactggtacctgcagaagtcaggccagccctccacgactcctgatttangtaacgtttccaagtcgtttagtttggagtgcagacgaggctcgaggtgacgacggcggtacgagggacagtactttacactacgttaagaaaacgttcgaagggtccggggttagggacggtcgtaggaacgggtagttgggttcggtacgttaagtttttacgtttagttagtacgtagttacgtaacgttaaagttttacgagttccgtttggtttaccttacgggtttttaccggacccggtaacgggtacccttaacggttcccgttaacgggaccttacgtaacccgtaaaccggg

SEQ ID NO: 105509 - DNA, 636 bp, Homo sapiens
  misc_feature: GYAE6OF02HDIXE.29.71.G05.1.454.CMB.1.raw
  modified_base (212)..(212): a, c, t, g, unknown or other
  misc_feature (212)..(212): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtccttgctaatgctctggatacctggatccaggtggagatattgagatgacccagactccactctctctcgtccgtccaccctggaccacggcccggtccctacccgacttccttcctcgactaacgttcctacgtacaacgacgtccctacgtcgactagtacggtagagtaaggaaacgtacctaattagtacgtactacggtacctagacaaggaacgtaccgtacggacccacgtaccctacccgtaccggtacctaccgttagttaacgtttagttaacggttaaacgtttaaccgtaacgtttaccgttttagttttacgggacggttcgtaccgaagtaaccgtacggtaccgtacgtacggtcggacggtacgggtaccggggtacgtaacgggg

SEQ ID NO: 105510 - DNA, 618 bp, Homo sapiens
  misc_feature: GYAE6OF02IW8JB.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctcatctcctgcaagtctagtcagagcctcgtgcatagtgataggaaagactatatgtactggtacctgcagagtcaggccagcctcacgactcctagtatttatacgtaacgtttccgaagttcgtttaagttttacgggagttcgccaaggtacgacggtcctacgacggtcggcgtacggtcgggtacgacggggactaggtactttacactaacgtaagaaaacgttcgacgggtaccggggttaggacggtcggttggacgggtagttggttacggtacttaagtttttaagtatttgtacgttaatgttaaccgttaaagtttacgtaactcggtttacgtttaccgttacggttttccggaccgtacggggtacctagtcccgtaggtacctacgtaacgtaaacgg

SEQ ID NO: 105511 - DNA, 531 bp, Homo sapiens
  misc_feature: GYAE6OF02FU3JX.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcgaggccagcctccaccgactcctgatttatgtaacgtttccaagtcgtttattttggagtgccagacaggctcgagtggcgaggcgggtcaggggacagtatttcactacagaaatcgaggccgggtaggaggctaggaggagtgttggctaattttatttagttgactatgtactaagtttacaggtcttagtttacgtacgttttcggaccgtacggggtacctacgttccgtggtacataaccg

SEQ ID NO: 105512 - DNA, 602 bp, Homo sapiens
  misc_feature: GYAE6OF02F1L0B.29.71.G05.1.454.CMB.1.raw
  modified_base (212)..(212): a, c, t, g, unknown or other
  misc_feature (212)..(212): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtccttgctaatgctctggatacctggatccagtggagatattgagatgacccagacctccactctctctcgtccgtccaccccgtggacacggccggccctccatcctcctgactaagtctagtcagacgccctggtcgctagtagtcgaagtaggaaaacgtaccttaagtagttacgttaccgtcggttacctgaccaaggtaacgtcgacgggccacggccctaccgaccgtaccttccgtagtacttttagacgttaacgtttaccgaaggttcgttttagtttacgggacgtttcggaccgtaaggaccgtacggtaccgttacggacggttcgggacgacggggtcccgggtagaaccggggg

SEQ ID NO: 105513 - DNA, 533 bp, Homo sapiens
  misc_feature: GYAE6OF02GGC8K.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagactatatgtactggtacctgcagagtcaggccagcctccacgacctcctgtatttatgtaacgtttccaagtcgtttattttggagttgccagacaggctgagtgcaggcgggtgagggacagtattcacactagaaatcgaggccgggtgaggctaggaggtagttggttggacttagtttagttattgactatagtactaagtttacgagtcttagttacttacggttttcggaccggtaacgggtacctacgttaccgtaggtacctagtaaccg

SEQ ID NO: 105514 - DNA, 613 bp, Homo sapiens
  misc_feature: GYAE6OF02JF2S1.29.71.G05.1.454.CMB.1.raw
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
  modified_base (496)..(496): a, c, t, g, unknown or other
  misc_feature (496)..(496): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtccacccctggacacggcccggcctccatcctcctgacaagtctagtcagacgcctcgtgcagtagtgagtaggaaagcctatatgtacgtggtacctgacagaagtcaggccagccctcacgtactcctgtatttagngtaacgttccaagtcgtttagtttggagtcgcaagacgnggctcgagtcggacgacggtccgggtagaacggggactagtaactttcgaaactacgaagtaaacgttcgagggtccgggtagacgggtactagggaggtagtaggttaggtacttagttttagtagtttnacgttagtagtaacgttaagtttacgacgttcgtttacggttaccttacggttttacggaacccggttaacgggttaccctacggttacccgtaacgggtacctaaccgtaaaccgg

SEQ ID NO: 105515 - DNA, 667 bp, Homo sapiens
  misc_feature: GYAE6OF02FSY2I.29.71.G05.1.454.CMB.1.raw
  modified_base (230)..(230): a, c, t, g, unknown or other
  misc_feature (230)..(230): n is a, c, g, or t
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
tcagatagagtactcacgaccggtgctcgatttagtgtcgtcgcaagagagaggggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtagtnctttcctgctaatgctctggatacctggatccagtggagatattgagtatcgacccagacctccactctctctcgtcccgtccaccccgtggacncggcccggcctccactcctccgtnactaagtctaagtccagtacgtcctcggtcgctaacgtaggtagtaagtacgggaaaacacctttaatagttacggttactcgggttaaccctggaacgtaaggtaaacgttccgaacggacccgtaccgtaccccgtacccgtaaaccgtaccctttacccgttacggtttaaacttttaagttaaccgggtttaaaacgttttcccggaaaaggttttcgttttaacgttttgggtacggttcgtaccgtaacggacgtacggtcccgttaggacggttacggtaccggacggggtccgggaggtacggggtaacg

SEQ ID NO: 105516 - DNA, 670 bp, Homo sapiens
  misc_feature: GYAE6OF02IWPDS.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctagggctgctaatgctctggatacctggatccagtggagatattgagatgacccagactccactctctctgtccgtcacccctggacagccgctccatctcctgcaagtctagtccagagcctcgtgcatagtgataggaaagacctatatgtactggtacctgcagagtcaggccagcctccacgacttcctgtatttatgtaacgtttccaaagtcgtttagttttggagttcgacctaagacgagggtccttacgaaggttcgggacgacgggtccgggggtaccgaagggggaacctaggttaacgttttaccgaaccgtaaccgtaagtaaaacttcggaacgggtaccggggtagggaacgggtcgtaggggaacggtacgtttgggttacggtacgtttaagtttttagtttaagtttacggtacttaaagttacggtaaccgtttaaacgttttaacgacgttcgtttaccgtttaacgttaccggttttacgggacccggtacgggttaccctaccggtttacccgtaggtacccgtaagtaaacccgg

SEQ ID NO: 105517 - DNA, 564 bp, Homo sapiens
  misc_feature: GYAE6OF02HMBHR.29.71.G05.1.454.CMB.1.raw
  modified_base (254)..(254): a, c, t, g, unknown or other
  misc_feature (254)..(254): n is a, c, g, or t
  modified_base (315)..(315): a, c, t, g, unknown or other
  misc_feature (315)..(315): n is a, c, g, or t
  modified_base (445)..(445): a, c, t, g, unknown or other
  misc_feature (445)..(445): n is a, c, g, or t
tcagatagagtactcacgaccggtgctcgatttagtgtcgtcgcaagagagaggggtgatcaggacttctcagttcatcttctcaccatgaggctccctgctcagctcctggggctgcgtaatgctctggatacctggatccagtggagatattgagatgacccagactccactctctctgtccgtcacccctggacagccggcctccatcctcctgcaagtctagtcagagcctcgtgcatagtgatggaaancctatatgtactggtacctgcagaagtcgaggccagccctccacgtacctcctgtatttangtaacgtttccaagtcgtttatttggagttcgaccgtagacgaggtctcgagtggcaggcgggtacagggacagtacttacgactaacgtagaaaatcgaacggtccggggtaggacggcgtggaaggtnttgggttagacttattttagttagttgactagtagtactaaacgtttcagttcttcggttacttacggtttacggaccggtacgggtactacgttcccgtaggtactactacgtaaacg

SEQ ID NO: 105518 - DNA, 582 bp, Homo sapiens
  misc_feature: GYAE6OF02GVYWB.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcgagggtgctgctgaggctgtaggtgctgtccttgctaatgctctggatacctggatccaggtggagtatattgagatcgaccagacctccactctctctcgtccgtcaccccgtggacgacgccggcctaccacttcctccgtcactaacgtctacgtcacgacgtccgtcggtcgactagtacggtagagtagggaaacgtaccttatagttcgtacgtcggtacctgacgagaagtcgacgccacgtccctccgacgtccttctaggttatttagtacgttaacgtttaccgaagttcgtttagtttagggtacgttcgaccaggtaccgaggtcctcgtacggtcggtacggacgggtcgggtacgtaacggg

SEQ ID NO: 105519 - DNA, 506 bp, Homo sapiens
  misc_feature: GYAE6OF02FU4S6.29.71.G05.1.454.CMB.1.raw
  modified_base (439)..(439): a, c, t, g, unknown or other
  misc_feature (439)..(439): n is a, c, g, or t
  modified_base (493)..(493): a, c, t, g, unknown or other
  misc_feature (493)..(493): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagacttttgtgtttctcgtagtctgctttgctcagcgtcagggtgctgctgaggctgtaggtgctgtccttgctaatgctctggatacctggatccagtggagatattgagatgacccagactccactctctctgtccgtcacccctggaccagccggcctcatctcctgcaagtctagtcagacgcctcgtagcatagtgaatggaaacgccttatatgtaactggtacctgcagaacgtcaggccagcctaccgacactcctgatttanagaagtttcaagtctttagtttgagtcgaccagtacacggcttcgacgttggcnggtcggtcaaggg

SEQ ID NO: 105520 - DNA, 593 bp, Homo sapiens
  misc_feature: GYAE6OF02GTSI5.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagacctccactctctctcgtccgtccacccgtggacacggccggccctccatcctcctgactaacgtctagtcagacgccctcgtgaccagtagtgagtagggaaacgtaccttatacgtgtaccgtaggtaccctgacagaacgtcgacgggcccagtcccctaccaccgaccttccgtagttactttagtacggttaacgtttaccgaaggttctttttaggttttacggacggttcgacccgtaggaaccgtacggtcctacggtacggtccgggacgtacggggtaccgggttacggaacgggg

SEQ ID NO: 105521 - DNA, 614 bp, Homo sapiens
  misc_feature: GYAE6OF02IBMKZ.29.71.G05.1.454.CMB.1.raw
  modified_base (311)..(311): a, c, t, g, unknown or other
  misc_feature (311)..(311): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgatggaaagcctatatgtactggtacctgcagaagtcaggccagccctcacgactcctgtatttangtaacgtttccaagtcgttagtttggagttcgccagtacaggtctcgaggtggcaggcgggtacaggggacaggtactttcactaactagaaaactcgaacgggtccgggtagggacggtcgtaggaacgggtagttggttagggacctttaagtttttaagtttaattcggtaacgtagttacggtaaccttaaaggttttaccgtaggttaccgttggtttaccgttacggtttttacggacccggtaacggggtaccctacgttacccggtacggaacttaccgtaaccgtaaaaccggg

SEQ ID NO: 105522 - DNA, 613 bp, Homo sapiens
  misc_feature: GYAE6OF02IBVMQ.29.71.G05.1.454.CMB.1.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (328)..(328): a, c, t, g, unknown or other
  misc_feature (328)..(328): n is a, c, g, or t
  modified_base (398)..(398): a, c, t, g, unknown or other
  misc_feature (398)..(398): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagactccactctctctgtcccgtcacccctggacacgccggcctccatcctcctgacaagtctagtcagngcctcgtgcatagngagtaggaaanacctatatagtactaggtacctgacagaacgtcgaggccacgcctaccacgacctcgtagtactttanagtaacttccgaagtcgttagtttggagtcgacgaagacaggcctagagtgcgaggtcggtagacggganagtattacacaacgtagtaaactacgacggtcgggtagggacgtcgtaggacgggtagttggttacggtacttaattttaacgtttagttcggtactaaggttagaacgttaaacgtttacgtcgtacgtttacggtttaccttacggttttaccgggaccgttaacggggtacctaacggttacccgtacggtaactaccgtaacgtaaaccgg

SEQ ID NO: 105523 - DNA, 583 bp, Homo sapiens
  misc_feature: GYAE6OF02H3A1Q.29.71.G05.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtcaccctgacncgccgcctccatctcctgacaagtctagcagngcctcgngacatagtgtanaggaaaactacctaatatgtaacttcggtacctgacaagaatcgaaggcctagccctacacgacttccagtatttatggaactttcgaaagttcgtttaatttcgggatcggacccaaggaccaagggcccttaggaggtcgggacacgggacggtggaacgggtacaaggactttccaactaacgagtaaacngaacggtcgggnggaggtntggagtagtgtagactatttagtagtgtcagtagtataagttacgtgtacgttcgttacgttacgttacgggaaccggagggttaaccctacgtaccgttaggtactaactaaccgtaaacg

SEQ ID NO: 105524 - DNA, 640 bp, Homo sapiens
  misc_feature: GYAE6OF02FKZA8.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgataggaaagacctatatgtactggtacctgcagaagtcaggccagcctccacgactcctgtatttatgtaacgtttccaagtcgtttattttggatgccagacaggctcgaggtcggcgaggcgggtacgaggggacaggtatttaccgaactacgtaagtaaaactcgaacgggtccggggttagggacgtcggtaggaacgggtagtttgggtttacgggtactttaagtttttaagttttaaggtttacgtacgttaagttacggtaacgtttaaacggttttaacgacgggtttactttacggttttaccttaaccggtttttacggggacccggtaacgggggtaaccccttaggttaccccggtagggtaacctaacgtaaaccgg

SEQ ID NO: 105525 - DNA, 752 bp, Homo sapiens
  misc_feature: GYAE6OF02IN3MI.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgtctttgctcagtcgtcgagggtgctgctggaggtctgtaggtgctgtccttgctaatgctctggatacctggactccaggtggagattattgagtagtcgacccagtacctcccacttcctcttcgtcgttcccgtacccaccccgttaggataccggcccggtcctaccctacttcccgttcctacggtacctaaacggttctaacgtacgaacggtacgtcccttacggttcgaccgtattaacggtgtaaagtaacgggtaaaacgtacccgttaaagttacgttacggttaaccgttacgggttaccctggtaacgtaaacgggtaacggttaccgaaccggtacccgaaccggtacccctacccgtaaaccgttaccctacccgtttagtttaacgttttacgttaagttaaaccggtttttaacccgtaagtttaccggttttttaaggttttcgggtaaccggttcggtaacccgtagggtaaaccgttacggggtaccttacggagggttaccgggtaccgaacgggggttccggggttaacggaacgggg

SEQ ID NO: 105526 - DNA, 689 bp, Homo sapiens
  misc_feature: GYAE6OF02JFUHD.29.71.G05.1.454.CMB.1.raw
  modified_base (273)..(273): a, c, t, g, unknown or other
  misc_feature (273)..(273): n is a, c, g, or t
tcagatagagtactcacgaccggtgctcgatttagtgtcgtcgcaagagagagggggacgtgatcaggacttctcagttcatcttctcaccatgaggctcctgctcagctcctgggctgctaatgctctggataccgtggactccagtggagatattgagtatgaccagactccactctctctgtccgtcacccctggaccagcccggtcctccgatctcctcgcaacgtctacgtcagcgcctcgtgcagtagtgagtaggaaacgacttanagtgtaacgtcggtacctgccaaggtaacgtcacggtccacgccctaccaacgtaccttccgtagtatttacgtacggtacgttttacctaaaggttcgttttaagttttacggaggtttcgacccgtaagtacgtaacggtcctacggtaaggtcggtacgtacgggcgggtacggaacgggtacgtaaggtacgtttaacgacgtaaacgtacggtaaaacttacggtaacgggtaccgggtagggtaacgggtcggtagggtaaggtagttacgggttggtacgttaagtttaacgtttagttacgttcgtaagttacggtacttaacggttacgtacgtcgttacgtttacgtacggttttacggacggttacgggtaccgtacgttaccggtacggtagtaccgtaaacgg

SEQ ID NO: 105527 - DNA, 630 bp, Homo sapiens
  misc_feature: GYAE6OF02GXNE5.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagacgcctcgtgcagttagtgagtaggaaaagtacctatagtgtactggtacctgacagtaacgtcgaggccagccctaccgacgaccttccgtagtatttatagtaacgtttaccgaagtcgtttagtttggagtcgaccgagacagctgaggtggcgaggcgggtcgaacgggactagtactttcgactaacgtaagaaacgtcgacgggtccggggtaggacggtcgtagggaacggtagttacgggtttaggactttaagttttacgtttaagttcgtaacgtagttacgtaacgttaacggttttacgagtttccgtttagtttaccgttacggttttcgggacccggttaaggggtaccctacggttcccggtaaggtacctacgtaaacccgg

SEQ ID NO: 105528 - DNA, 741 bp, Homo sapiens
  misc_feature: GYAE6OF02H37JV.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatgacccagactccactctctctgtccgtcaccctggacacgccggcctccattcctcctgcaagttctagtcaggacgtcctcgtgctaagtagtgagtagggaaactaccttatatcgtacttacggtaccctgacgaaggtaacgtcgacggccacgccctaccgacgtacctccgtagtatttatagtaactttaccgaagttcggtttatttagggtagtcgaccgtaggaacgtacggtactcgaagggtcgggacgacgggtcgggtacggacgggaacgtaggttactttacgaactaacgtaaagtaaaacgtacggtacgggtccggggtagggacgggtcggtaggtaacgggtaggtttacgggttaggttacgtttaagttttaagtttacggtttacggtacgttaaggtacggttaaacgttaaacggttttacgtacggtttaccggtttaacggttttacccgttttaaccgggttttaccggggttaaccgggtaacccggggttacccttaaccgggttacccgttaacggggtaactaaccggtaacccggttaaaacccggg

SEQ ID NO: 105529 - DNA, 686 bp, Homo sapiens
  misc_feature: GYAE6OF02JUNHO.29.71.G05.1.454.CMB.1.raw
  modified_base (161)..(161): a, c, t, g, unknown or other
  misc_feature (161)..(161): n is a, c, g, or t
  modified_base (605)..(605): a, c, t, g, unknown or other
  misc_feature (605)..(605): n is a, c, g, or t
  modified_base (640)..(640): a, c, t, g, unknown or other
  misc_feature (640)..(640): n is a, c, g, or t
tcagatagagtactcacgaccggtgctcgatttagtgtcgtcgcaagagagagggggactgatcaggacttctcagttcatcttctcaccatgaggctccctgctcagctcctgggctgctaatgctctggatacctggactccaggtggagtatatgagntcgaccagactcactctctctgtccgtccacccgtggacacgcccgcctaccatcctcctagcctaagtctagtcagacgtcctgtgactagtacggtgaacgttacgggaaaactaccgttatcggtaacgttaaccggtacggtaccctagtaccggaaagttaacgtccgagggtaccccacgggtaccctccggaaaccgtcttaccgtaggtactttacggacggttaacttaccgtaagttggttttacttggggaactcgtaccgagtaacggactccgtagggtacgtcggacgtaaggccggtaggacggtactagttactacgaactagtaaggtacacggtacgggtcgggaagtcgtactagggtacgttaacggttgtacgtacgtttttaaatcgggttagacgtacgtgttaacggtaacgttcgttanaggtttccggttaacgttacttaccggggtaaccncggttaaccggcttacgggttaccaacggtcttaaccggtaaccgg

SEQ ID NO: 105530 - DNA, 555 bp, Homo sapiens
  misc_feature: GYAE6OF02GPNT4.29.71.G05.1.454.CMB.1.raw
  modified_base (213)..(213): a, c, t, g, unknown or other
  misc_feature (213)..(213): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgctcagcgtcagggtnctgctgaggctgtaggtgctgtccttgctaatgctctggactaccgtggatccgagtggagtatattgagatcgacccagactccactctctctcgtcccgtccaccccgtggacacgcccggccctccacttcctcctgacaagtctacgtcagacgcctcgtgactagtagtgagtaggaaatacctatatgtactcggtactgacagacgtcgacgccacgccctaccgacgtacctcgtagtatttagtaagtacgtttacctaagttcgtttagtttaggagtcgacctaggtaccgaggtcctacgcggttacggcgacgggtcggtacggaaggg

SEQ ID NO: 105531 - DNA, 706 bp, Homo sapiens
  misc_feature: GYAE6OF02H0RME.29.71.G05.1.454.CMB.1.raw
tcagatagagtactcacgaccggtgctcgatttagtgtcgtcgcaagagagaggggtgatcaggacttctcagttcatcttctcaccatgaggctccctgctcagctccgtggggctgctaatgctctggataccgtggactccaggtggagatagttgagatcgacccagactccactctctctcgtccgtcaccccgtggaccacggccggccctcctactcctcctcggacaacgttctacgtacacggtacgcctcgtcgactagtagtgataggaaactctatgcgtacgtggtcctgacaagaacgtcacggaccacggtccctacgacctaccgtcctagtacttaagtagttaaaccgtttccgtaaaggtttccgttttaaagtttcgggtactaccgtaccgtaaagacgtacgggtcctaggtacggtaggacgacggtacgggtacggacggacgtagtacttaccgacgtaacgtaacgtaaacgtcggacggtaccggggtaggaccgggtacgtagggtaagggtaggttacgggtttacggtagtttaacgttttaagttacgttacgtcgttaagtaccggttaaacgtaacggtttacgtacgttacgttcggttttaacttacggtttacgggtacccgtagggttaccctacggtccgtacggtaactaccgttaacggaaaccgg

SEQ ID NO: 105532 - DNA, 513 bp, Homo sapiens
  misc_feature: GYAE6OF02FOW9C.29.71.G05.1.454.CMB.1.raw
  modified_base (361)..(361): a, c, t, g, unknown or other
  misc_feature (361)..(361): n is a, c, g, or t
  modified_base (439)..(439): a, c, t, g, unknown or other
  misc_feature (439)..(439): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatcagtggagatattgagatgaccagactccactctctctcgtccgtccacccctggacacgccgcctccactcctcctgcagtctagtcagacgcctcgtncatgtgaatggaaataccttatactgtactggtacctgacagtagtcaggccagccctccacgactctagtatttacngtaacttccgaagtcgtttagtttggagttcgccagaccgaggtcctagcggtcggctacggtcgggtacaggg

SEQ ID NO: 105533 - DNA, 623 bp, Homo sapiens
  misc_feature: GYAE6OF02I7H7B.29.71.G05.1.454.CMB.1.raw
  modified_base (320)..(320): a, c, t, g, unknown or other
  misc_feature (320)..(320): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggaccagccggcctccatcctcctgcaagtctagtcagacgcctcgtgcatagtgataggaaagacctatatgtaactggtacctgcagaacgtcaggccacgcctccacgacctcctgtatttnagtaacgttacaaagtcgttagttttggagttcgccagacgaggcctcgagtcggcgaggcgggtacgaagggactaagtatttacgaactaacttacgaaaatcgacggtaccgggtggaacggtcgtagggacggtaagttcgggttacggtacgttagttttaacgttacttacggtaccgttaaggtacgttaaccgttaaaaggttttccggtaacgtccgttttagttaccgttaacggttttccggggaaccgtacggggtacctaccgtcccggtacggtactaacgttaaccgg

SEQ ID NO: 105534 - DNA, 536 bp, Homo sapiens
  misc_feature: GYAE6OF02H5XID.29.71.G05.1.454.CMB.1.raw
  modified_base (438)..(438): a, c, t, g, unknown or other
  misc_feature (438)..(438): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtccacccctggaccacgccggcctccatcctcctgcaagtctagtcagacgcctcgtcgcattagtgataggaaactacctatatgtactggtacctgcagagtcgaggccagccctccgacgtactccgtntactttatgtaactttaccaagttcgtttattttagacgttcgaccgtaagacctagggtacctcgaggtccggacgacgggtccgggtagaacgggg

SEQ ID NO: 105535 - DNA, 638 bp, Homo sapiens
  misc_feature: GYAE6OF02GHK1O.29.71.G05.1.454.CMB.1.raw
  modified_base (328)..(328): a, c, t, g, unknown or other
  misc_feature (328)..(328): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacacgccggcctccatcctcctgacaagtctagcagacgcctcgtgctaatagtgagtaggaaacgacctatatgttactggtacctgcaagaagtcgaggccagccctaccacgactcctagtattttanagtaacgtttccaagttcgtttagttttaggagttcgaccagacgcggtctcaggtcggcgacggcgggtacgagggacagtactttacgaactacgtaagaaactcgacgggtaccggggtaggacgggtcgtagggaggttaggttggttacgggtactttaagtttttagttagttagtacgtaagttcgtaacttaagtttaacgacgttacgtttacggttttacccgttacggtttttaccgggaacccgggttaacggggtaccctaacggttacccggtaacggtacctaacgtaaacccgg

SEQ ID NO: 105536 - DNA, 752 bp, Homo sapiens
  misc_feature: GYAE6OF02HF4XA.29.71.G05.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (381)..(381): a, c, t, g, unknown or other
  misc_feature (381)..(381): n is a, c, g, or t
tcagatagagtactcacgaccggtgctcgatttagtgtcgtcgcaagagagaggggtcgaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctggtaggtncctgttccttgacttaagtgcttcgtggactaccgtggaacttccgaggtggagtattagttgaagtatcgaaccctagacctcacttctcgtctcgttacccgtccaccccgttggaccacggtccccggcctaccgtattccctcccngtacctaagtaccgttacggtaccgaagtacgcctaacgttccggttagactaagttacggtagtaaacgtacggggtaaaactacccttaagttaagttaccggttaacgttacggttaacccgttcggtaacgaaacggtaaaccggttcggaaccggtaaccccacggttaccccctaacccgtaacccggtacccttacccggtttaggtttaaacttttaccggttaaacgttaaacccggtttttaaccgaaacgggttttccgttttttaagggttttacgggaacgttaccggacccgtaacggtaacggtaccggttacttaccggtagggttccgggacgttacggggccgggttaacggg

SEQ ID NO: 105537 - DNA, 565 bp, Homo sapiens
  misc_feature: GYAE6OF02FWVGL.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagagtcaggccagcctccacgactcctgtatttatgtaagtttccaagtcgtttatttggagtgccagacaggctcgagtggcgaggcgggtacgagggacagtatttcacactagaaatcgaggtccgggtaggacggacgtggaaggtattggttggtacgtaagtttttattagtttcgactagttggtacgtaaagttttacaggtcgtttcgttacgttacgttttcgggaccgttaacggggtaccctacgttacccgttagggacctacgtaccgtaaaaccg

SEQ ID NO: 105538 - DNA, 718 bp, Homo sapiens
  misc_feature: GYAE6OF02G20NX.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacagccgcctccatctcctgcaagtctagtcaggacgtcctcgtgactagtaggtagtaagtaacgggaaaacgtacccttaagttacgttcgttaacgttacgggttaccctggacgaaggtaacggtcgaacggacccacgtccctacccgaaccgtaccttccgttagttaattttagtaggttaaacgtttaccgaaacggtttcggttttagttttagggagttccggaccgtaacggaacgtacggtccttacggagggtcggacgacgggtccgggtacggaacgggtacaagttacttacaacgtaacgtaagaaactcgaacgggtccgggtaggacggtcgtaggaggtcgttggttacggtactttaagttttaagttacgttacgtactaagttacgtaaacgttaaacgtttacgacggttcgtttaccggttacctttacggtttaccgggaaccggttacgggtacccttacggttaccgtaacgggtaacttacgtaaccgtaaacgg

SEQ ID NO: 105539 - DNA, 620 bp, Homo sapiens
  misc_feature: GYAE6OF02JX57A.29.71.G05.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
tcagatagagtactcacgaccggtgctcgatttagtgtcgtcgcaagagagaggggtcgaggctggaactgaggagcaggtgggggcgacgttctccctctaacactctcccctgttgaagctctttgtgacgggcgagctcaggccctgatgggtgacttcgcaggcgtagactttgtgtttctcgtagtctgctttgctcngcgtcagggtgctgctgaggctggtaggtgctgtccttgctaatgctcgtggactaccgtggactccgagtgggacgtatagttgaagatcggacccagacctacccactctcctctcgtcccgtccaccccgttggaacctcgcccgtcccncctactcctcctcgacaacgttctagtcgagtactcccgtcgtgactagtagtgagttaggaaacgtactatattagtacgtacggtacctgaccgtaaagtaacggtccgacgggtacccaggtaccctacccgaaccgtacctccgtagttacttagttacgtaaccgttttaacaacggtttcctttagtttacgggtaatcggtaaccttagaacggtacgtcttacggtaggtcggacgacgggttcggcggtaacggg

SEQ ID NO: 105540 - DNA, 645 bp, Homo sapiens
  misc_feature: GYAE6OF02HLWCB.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcaccctggacagcccggcctccatctcctgcaagtctagtcaagacgcctcgtgcatagtagagtaggaaagtacctatactgtaactggtacctgacaaggaagtcaggccagcctaccaacgacctcctagtacgtttatacggtaacgtttaccgaagttcgttttaagttttggacgtcggacctaagacagggtcctagacggttaggcgaacggtccggggttacgaacgggtacaaggtatttacaacgtaactagtaaacttacgacgggtaccggggttaggacggtcggtaggtagggtacggttaggttacgggtacgttaagttttaacgttagttagtctaagttacgtaacgtttaacgtttactaacggtcgtttagtttaccgttacggtttacggtaacggtacgggtaacctacggttaccgtacggtactacgtaacg

SEQ ID NO: 105541 - DNA, 577 bp, Homo sapiens
  misc_feature: GYAE6OF02FO43P.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacacgccggcctccatctcctgcaagtctagtcagagcctcgtgcatagtgatggaaagacctatatgtactggtacctgcagagtcaggccagcctccacgacctcctgtatttatgtaagtttccaagtcgtttatttggagtgactagacaggtctcgaggtggcgaggcgggtcgacgggacagtactttacacactagaaatcacggcgggtggaggcgtaggaggtagttggttggtacttaagttttatttagtttgactagttcgtaattaacgtttacgtacggttcgttacgtttacgttaacggtttttcgggacccggttaacggggtacccttacgttacccggttacggtaacctagttaaacccg

SEQ ID NO: 105542 - DNA, 736 bp, Homo sapiens
  misc_feature: GYAE6OF02HGSV7.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatgacccagactccactctctctgtccgtccacccctggacacgcccggcctccactcctcctgcaagtctagtcagacgcctcgtgactagtagtgagtaggaaacgtacctatatcgttacgtcggtacctgacaggtaacgtcgacggcccacgccctaccgaccgtaccttccgttagtaattttaacgtacggttaaacgtttaccgtaaaggttaccgtttttaaggtttttagggaacggttcgaacccgtaagaaccggtacgggtccttacggagggttcggacggtagggtccggggtacgaaggggaactacgtatttaccgaaataacgtaaagaaactccggaacgggtccggggtaggacgggtcgtagggtaacggtggtttagggttacggtacgtttttaaagttttacgtttaacgttacgacgttaaggttaccgtaaacgtttaaacggtttactaccgggttacgtttaccggttttacgttaaccgggttttaccgggaccggtaaccggggttacctacccggttcggtacggtaaaccctacgttaaaccgg

SEQ ID NO: 105543 - DNA, 632 bp, Homo sapiens
  misc_feature: GYAE6OF02JLW8Q.29.71.G05.1.454.CMB.1.raw
  modified_base (322)..(322): a, c, t, g, unknown or other
  misc_feature (322)..(322): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagacgcctgtgcatagtgataggaaagtacctatatcgtaactggtacctgacagaagtcaggccagccctccacgtacctctagtatttanagtaagtttccaagtcgttttaagtttggaagttcgacctaagacgagtctagaggtcggacgagggtacgggtacgaacgggactaggtactttacgaagtaccgtaagaaaactcgacgggtaccgggtaggaacggtcgtaggaacggtgttcggttaggtacttaagttttaagtttactgtaaacctagttacgaaacgtttaagtttacgtaggttcgttaacgttttccgttaaacgttttccgggaaccggttaacggggtaacccttaggttacccggtaaggtacctaacgttaaaccgg

SEQ ID NO: 105544 - DNA, 567 bp, Homo sapiens
  misc_feature: GYAE6OF02HJRCH.29.71.G05.1.454.CMB.1.raw
  modified_base (311)..(311): a, c, t, g, unknown or other
  misc_feature (311)..(311): n is a, c, g, or t
tcagatagagtactcacgaccggtgctcgatttagtgtcgtcgcaagagagaggggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagacgcctcgtgcatagtgatggaaagacctatatgtactggtacctgcagagtcaggccagcctccacgctcctgtattangtaatttcaagtcgttatttggatgaccagtacaggtctcgagtggacacggcgggtcgagggacaggtatttacgaactaactaacgaaaatcgacggtccgggtagggaggcgtaggaggtagtggttacggtactaagttttagttaagttagtactagtagtaactaaaggttacaggtacttcggttacttacggtttcggaccggtaacggggtacctaacgtccgtaggtaactacgtacgtaaaacgg

SEQ ID NO: 105545 - DNA, 619 bp, Homo sapiens
  misc_feature: GYAE6OF02G73T5.29.71.G05.1.454.CMB.1.raw
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagacgcctcgtgcatagtgataggaaagacctatatgtactggtacctgcagaagtcaggccagcctccacgactcctagtatttanagtaacgtttccaagtcgtttagttttgggagtcgccagacgnggctcgaggtggcgacggccgggtacgacggggacaggtactttccaactacgtaagaaactcgacgggtccggggtagggacggtcgtaggagggtagttgggttaggtacgttaagtttttaagtttagtttgtcgtagtacgtaacgttaaaggtttacgtaggttcgtttacggtttaccttaacggttttccgggaccggtaaccggggtaacctacggttacccgtaggggtaacctaacgtaaccgtaaaccgg

SEQ ID NO: 105546 - DNA, 607 bp, Homo sapiens
  misc_feature: GYAE6OF02HDAUA.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccaggtggagattattgagatgacccagacctccactctctctcgtccgtcaccccgtggacacgccgcctccatcctcctgctaagtctagtcagacgcctcgtgctagtagtgagtagggaaaacgacctaatactagttacgtcggtacctggactaaggaacgtcacggcccaacggtccctacccgaccgtaccttacccgtagtaacttttacgtacgtaaacgttttacccgaaggttccggttttagttttcgggaggttcgtacccgtaaggtaaccgacgggttacctcggtaacgggttcgggaccgtaacggggtccggggtacgtaacggggg

SEQ ID NO: 105547 - DNA, 764 bp, Homo sapiens
  misc_feature: GYAE6OF02JZ300.29.71.G05.1.454.CMB.1.raw
  modified_base (712)..(712): a, c, t, g, unknown or other
  misc_feature (712)..(712): n is a, c, g, or t
  modified_base (756)..(756): a, c, t, g, unknown or other
  misc_feature (756)..(756): n is a, c, g, or t
tcagatagagtactcacgaccggtgctcgatttagtgtcgtcgcaagagagagggggactgatcaggacttctcagttcatcttctcaccatgaggctccctgctcagctcctgggctgctaatgctctggatacctggactccagtggagtatattgagatgacccagactccactctctctgtccgtcacccctggaccagcccggcctccatcctacctgcctaagtccttaggtccagacgccctgtcgccaattaggtcgagtagggaaaactaccttagtattacgtaacttcgggtaaccctagccgtaaagagttaccgaacggccgtaacgtcccgtaacctaaccggtaaccttcccgttaggtaacttttttaacgacggttaaacggttttacccgtaaacggttacgttttttaaggtttttacgggacggtttaccggtacctaaacgggttaaccccggtaggggtccttaccgggtaacgggtttacgggaccgtaaacggggtccgggggtttaaccggaaacggggggtactaaacgggtttaagttttacccgaaacgttaaccttaaaggaaaaacgttcggtaacgggccggggttaaggcggtaccgtagggaaggtaaccgttggtaggtacgttaatttaccgtttagtgacgttatacgtacgtaagtttacgagtttctacggttnttaacggtttcggacgtacgggtactcgttacggagtaaccgtnttaaccgg

SEQ ID NO: 105548 - DNA, 616 bp, Homo sapiens
  misc_feature: GYAE6OF02F5IWG.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcaccctggacacgccgcctccatcctcctgctaagtctagtcagacgtcctcgtgctatagtgataggaaacgaccttaatatgtactcggtacctgacgagaagtcgacggccacgcctaccacgtacctcctagtatttatacgtaacgttccaagttcgtttagttttggagttcgaccagaccgacggtctacgaggtcggacgacggtcgggtacgaacgggactagtactttacgaactaacgtaagaaacgtcgacgggtaccgggtaggacggcgtagggacggtagttcggttacggtacttaagttttacgttagttcgtactagtgtaacgttaagttacgagttacgttcgttacgttaccggttttacggaccggtagggtaacctacgttacccggtaggtacctacgtaaccg

SEQ ID NO: 105549 - DNA, 595 bp, Homo sapiens
  misc_feature: GYAE6OF02G9M7A.29.71.G05.1.454.CMB.1.raw
  modified_base (353)..(353): a, c, t, g, unknown or other
  misc_feature (353)..(353): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatcgaccagactccactctctctgtcctcacccctggacacgccggcctccatcctctgcaagtctagtcagacncctcgtcgctagtacgtgtaagtacggaaagtacctattatcggtacgtcggtacctgaccgagtaacgtcgaagcccagccctaccgacgtacctccgtagtaacttttagacggttaaacgtttaccctaaggttaccgttttagtttttagggacggttcggtacctaacggtacctaacgggtccttaccggtaggtccgggtaaccgtacggggtaccggggtacggtaaccggggg

SEQ ID NO: 105550 - DNA, 699 bp, Homo sapiens
  misc_feature: GYAE6OF02GD2PY.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctggtaggtgctgtccttgctaatgctctggatacctggatccagtggagatattgagatgacccagactccactctctctgtccgtcaccccgtgacacgccggcctccatcctcctgacaagtctagtcagacgccttcgtcgactagtaggtgtaagttacgggaaaacgtacccttaagtacgttacggttaaccgttacgggttaaccctggtaacccgtaagggtaaacgttaccgaacgggtaccccaaccggtacccccttacccgaacccggtacccttacccgttaaggttaactttttaaagttaacggttaaaccggtttttaacccgtaaagggtttaccggtttttagttttttacggggtacgtttcgggtaaccccgaacgggtaacccgaacggggttacccttacgggtaacgggttccgggacccggtaggggttacccggggttacggtaaacggggg

SEQ ID NO: 105551 - DNA, 606 bp, Homo sapiens
  misc_feature: GYAE6OF02F3ENV.29.71.G05.1.454.CMB.1.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (475)..(475): a, c, t, g, unknown or other
  misc_feature (475)..(475): n is a, c, g, or t
  modified_base (522)..(522): a, c, t, g, unknown or other
  misc_feature (522)..(522): n is a, c, g, or t
tcagatagagtactcacgaccggtgctcgatttagtgtcgtcgcaagagagaggggtcgaggcgtggaactgaggagcaggtgggggcgacttctccctctaacactctcccctgttcgaagctctttgtgacgggcgagctcaggccctgatgggtgacttcgcaggcgtaagtaccttttggtgtttcctagttcgtcttgtcgtttgcctacgtagcgttacaggggtcnctgcgtgaggtctggttggngctaggttccttgacttaangtcgtctggataccgtggaatcctagtcgagatntgagatcgacagactacatccgtctctacgtcccgtctaccctcggaacnccgaccgtcctccgacttcgccctgacacggtactacgtacgtcgaacctccgtcgttagcctagttacgtagaacgtaggaaacgtaactagtacttagtacgtacgtacgttcganacgaatacgacgtacgccgtcctcgacctactcccttagtactttanacgttactaaccgtagtacgttattcggtagtcgtaccgaataccgtggacgttacgacgtcggtacgcggtcgacggtaacgg

SEQ ID NO: 105552 - DNA, 632 bp, Homo sapiens
  misc_feature: GYAE6OF02JP6SQ.29.71.G05.1.454.CMB.1.raw
  modified_base (184)..(184): a, c, t, g, unknown or other
  misc_feature (184)..(184): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
tcagatagagtactcacgaccggtgctcgatttagtgtcgtcgcaagagagaggggtcaggctggaactgaggagcaggtgggggcacgttctccctctaacactctcccctgttgaagctctttgtgacgggcgagctcaggccctgatgggtgaccttcgcaggcgtagactttgtgtttcncgtagtctgtctttgctcagctcgagggtnctgctagnggctgtaggnctgttccttgacctatgctctggtactaccgtggacttccgaagttggagtattaagtcgagtatcgaccagacctcactctctctcgtcctcctacccgtggaccacgcccgtccctacgattccctcctcggactaacgtcgttacgtctagacctcccgtttgcggacctaagtacgtagtaacgtaggtaaacgtaccgtaattacgtacgtaacgtcgtaaccgtgacgtagtaccgtagacggaccacgtcccgtacgacccgtactccgtagttacgtttacttaaggtacgtttaccgagttaccgtttaggttttcggaacggttcggtaccaacggtacgtacccgtaggtccgtaggtacggtaccggacggtcggtaccggtaacggg

SEQ ID NO: 105553 - DNA, 731 bp, Homo sapiens
  misc_feature: GYAE6OF02IC2TT.29.71.G05.1.454.CMB.1.raw
  modified_base (214)..(214): a, c, t, g, unknown or other
  misc_feature (214)..(214): n is a, c, g, or t
  modified_base (290)..(290): a, c, t, g, unknown or other
  misc_feature (290)..(290): n is a, c, g, or t
tcagatagagtactcacgaccggtgctcgatttagtgtcgtcgcaagagagagggggtcaggctggaactgaggagcaggtgggggcacttctccctctaacactctcccctgttgaagcttctttgtgacgggcgagctcaggccctgatgggtgacttcgcaggcgtagactttgtgtttctcgtagtctgtctttgctcagcgtcagggtnctgctggaggtctgtaggtgctgtccttgcttaagtgcctgtaggattaccgtggactccgtaggtggaagtattnttggagtactcgaccctagaccctaccacttccttccgtcgtcgtccgtacccaccccgtaggaccgaccggccccgtcctaccctacgttccctaccgtcggacctaaacgtttcgtaaccgttaccgaaggtacccgttcccgttcggtagtacctaaaggtttaaggtcgtaaaggttaaacggtaaacgtacctaagttacgtacggttaccgttacggttaccgtacgaacgtaaggtaacggtaccggacggtaccaccggtaccccaccgtaaaccgttaccgttaccgttaagttaacttttaacgtaacggttaacgtttaaccgtaagttttcggttttaacgttacggtaacggtccggtaaccgtacggaaccgttacggcttacggtacggttcgggaacgtacggggtaccgggtaacggtaacggg

SEQ ID NO: 105554 - DNA, 674 bp, Homo sapiens
  misc_feature: GYAE6OF02HIFQW.29.71.G05.1.454.CMB.1.raw
  modified_base (326)..(326): a, c, t, g, unknown or other
  misc_feature (326)..(326): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagacctccactctctctgtccgtcacccctggacagcccgcctccatctcctgcaagtctagtcagacgcctcgtgcagtagtgagtaggaaacgtcctaatatagtactggtacctgacagaagtcagccacgccctcacgtaccttcctgtactttanagtaacgtttaccaaggttcgtttaagttttgggacgtcgaccaaggacgtaaggctcgtaggtcggcgtacggcgggtacgaagggactagtacttacgaactacgtaagaaacgtcggtacgggtccgggtaggacggtcgtaggaacgggtacgttcgggttaggtacgtttaagtttttacgttacgttcgtacgttaagtttaggtaaaccctttaaagggttttaaccgaggtttaccgtttaccggttttaaccgttacggttttttacccggggacccggttaaccgggggtaaccctaacggtttacccggtacgggtaaccgttaacgttaaacccgg

SEQ ID NO: 105555 - DNA, 567 bp, Homo sapiens
  misc_feature: GYAE6OF02HAT9Y.29.71.G05.1.454.CMB.1.raw
  modified_base (182)..(182): a, c, t, g, unknown or other
  misc_feature (182)..(182): n is a, c, g, or t
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (360)..(360): a, c, t, g, unknown or other
  misc_feature (360)..(360): n is a, c, g, or t
tcagatagagtactcacgaccggtgctcgatttagtgtcgtcgcaagagagaggggtcaggctggaactgaggagcagtgggggcacttctcctctaacactctccctgttgaagctcgtttggtgacgggcgagctcaggccctgatgggtgacttcgcaggccgtagactttgtgtttcncgtagtctgcttgctcagcgtcagggtnctgctgaggctgtaggtnctgtccttgctaagtgctgtggatacctggatccagtggagtatatgagatggacccagtacctccactctctctcgtccgtcaccctggacacgccgcctcatctctgctaagtctagtcagacgcctgtnactagtagtgagtaggaaagacctatagtgtacgtcggtacctagcctaaggacgtcacgggtccacgccctaccacgtacctccgtagtacgtttatacggtaacgtttcgaacgttcgtttacgtttacgggacgttcgaccgtaggtaccgtagtcccttaggtaccggtcgggtcctaacggggttccgggtacgtaacgggg

SEQ ID NO: 105556 - DNA, 895 bp, Homo sapiens
  misc_feature: GYAE6OF02IIBPD.29.71.G05.1.454.CMB.1.raw
  modified_base (217)..(217): a, c, t, g, unknown or other
  misc_feature (217)..(217): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccgagtggagattagttgagatgacccagactccactctctctgtccgtccacccgtggacacgcccggcctccntcctaccgtgacctaagttcctaaggtccaggtacgtccccgtagtcgcctaagttaggtagtagtaagggtaaactacccgttatagttcgtaaccgttggtaaccttcgacgtaacgtaacgtccgacggtacccgaaccgtcccgtacccgaaacggttcccttaccccgttaggttaaacgtttttaaccgtaaggttaaaccggttttacccgaaaagggtttcctttttaaagggtttttacgggacggttaacgcccgtaaaaggttacgggtaaccggtaccgttacggaacgggttcgggagtaccggggtaccgggtagggaacgggtaactagggtttaactttacgaaacggtaaccggttaaagtaaaaccggtcccggttaaacgggggtaccggggtaccgggtaaaccgggttcgggtaaccggggtaagggtttaacccgggttgggttttaaaccggggtaccttttaaaggttttttaaaacggttttccgtaggttaacccgtaaacgtttaaccggtaaaaccggtttaaacggtttccggttaagtcccggttttaaccggtttccgtttaaaccgggtttcgggtaaaccccggtaacgggttaacccggttaccgtaaaccgggtacccgggtaacctttaaccgggtaaaccg

SEQ ID NO: 105557 - DNA, 717 bp, Homo sapiens
  misc_feature: GYAE6OF02HUGFV.29.71.G05.1.454.CMB.1.raw
tcagatagagtactcacgaccggtgctcgatttagtgtcgtcgcaagagagagggggactgatcaggacttctcagttcatcttctcaccatgaggcctccctgctcagctccgtggggctgctaatgctctggatacctggatccagtggagattattgagatcgacccagacctccactctctctcgtccgtccacccgtggaccacggcccggccctccatcctccgtcgacaagttctagtcgagacgcctcgtgactatagtgagtaaggaaacgaccttagtatacgtacgttacggtacctgacgaagacgtacgacggccacgccctaccgaccgtacctccttagtaactttatacgttaacgtttaccgaaggttcgttttagtttggacgtcgaccgagacgtacggtcctaggacggtcgacgacgggtaccgggtacggaacggaacgtaggtactttaccgaacgtaacgtaaacgtaaacgtcggacggggtaccggggtaggacgggtacgtagggtaaggttacggttagggttacggtaacgttttaagtttttacgttaagtttccggtaaacttacggttaacgttaacgttaacgtttaacggtacgttacggtttacgtttaccgttacggtttacccgggaccggtaacggggtacccttacggttacccggtagtaaccgtaacgtaaacccg

SEQ ID NO: 105558 - DNA, 725 bp, Homo sapiens
  misc_feature: GYAE6OF02I43UC.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctcgtggatacctggatccagtggagatattgagatgacccagactccactctctctcgtccgtccaccccgtggacacgccgcctcatctctgacaagtctagtcagacgcctcgtagctaagttaggtagaagtaaggaaacgtaccttaatagtagttaacgttcggtaacctgacgaaggtacgtacgacggaccacgtccctaccgaccgaccttccgtagtaatttataggttaaacgtttccgaaagttccgttttaagttttggaacggttcaacgagacgtacggtctacgtaggtcggacgtcgggacgggtacggacgggtacgtagtactttaccgaaacgtaacgtaagaaaacgttcggacgggtaccggggtagggtacggtacgtacgggtaagggtagtttgggttacggtacgtttaaatttttagtttacgtttaacggtcttaaaggtagttaaacgtttaaacgttttaacggtacggttacttttaccggtttacgttaaccggtttttacggaacccgggttaacggggtaacccttacggtacccggtttaacgaccgttaacgttaaacccgg

SEQ ID NO: 105559 - DNA, 667 bp, Homo sapiens
  misc_feature: GYAE6OF02G2Q6R.29.71.G05.1.454.CMB.1.raw
tcagatagagtactcacgaccggtgctcgatttagtgtcgtcgcaagagagaggggactgatcaggtacttctcagttcatcttctcaccatgaggctccctgctaagctcctgggctgctaatgctctggatacctggatccagtggagatattgagtatgacccagactccactctctctgtccgtcacccctggacagccggcctcatctctgcaacgtctagtcagagcctcgtgccatagtcgatggaaacgcctatatgtaactggtactgcagtaagtcacggccaggcctcctaacgacttcctgtaactttagcgttaacgtttccaaacgtcgtttagtttacggagttcgcctaagaccgtagggtcctcgtaagtcggacgaggtacgggtcgaaggggtaccaaggggttactttccgaaacgtacgtaaacgtaaaacgtccgaacgggtccggggttagacggtacgtacggtaaggaacgttcggttacgggactttagttttaacttaggttactacgtaacgttagaaccgttaagtttacccggaagtttcccgtttaaggttaccgtttaaccgggtttacgggacccgtaacgggggttaccctacgttacccggttacggtaccgtacgtaccggtaaaacccgg

SEQ ID NO: 105560 - DNA, 746 bp, Homo sapiens
  misc_feature: GYAE6OF02F98LB.29.71.G05.1.454.CMB.1.raw
  modified_base (239)..(239): a, c, t, g, unknown or other
  misc_feature (239)..(239): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagacctccactctctctgtccgtccacccctggacacgccggcctccatcctcctgacaagtctagtcagacnccctcgtgctatagtgagtaggaaaacgtaccttaatattcgttaaccgttcggtacccgtagacgaaggtaacgtcgaacggccacgccctacccgaccggtaaccttccgtagttaacttttaagtacggttaaaacgttttcccgaaaggtttccgttttaagttttgggaacgttcgacccgaaggtaaccgtacgggtaccgttacgagggtcgggaccgtaggggtcccgggggttacgaacggggaacttaaggttaccttttaccgaaacgttaacctaaaggtaaaaccgttcggaacgggttcccgggggtaaggacggtcgttaggacgggtatttcgggtttagtaactttaattttacgttagttacgtactagtacggtaacttaaacggtttacgacggttcgttttacggttactttaccgggttttacgggaacccgggttacgggtacccttaacgtccccggtaagggtacctaaccggttaaaccgg

SEQ ID NO: 105561 - DNA, 656 bp, Homo sapiens
  misc_feature: GYAE6OF02JK5G6.29.71.G05.1.454.CMB.1.raw
  modified_base (128)..(128): a, c, t, g, unknown or other
  misc_feature (128)..(128): n is a, c, g, or t
  modified_base (136)..(136): a, c, t, g, unknown or other
  misc_feature (136)..(136): n is a, c, g, or t
  modified_base (150)..(150): a, c, t, g, unknown or other
  misc_feature (150)..(150): n is a, c, g, or t
  modified_base (156)..(156): a, c, t, g, unknown or other
  misc_feature (156)..(156): n is a, c, g, or t
  modified_base (214)..(214): a, c, t, g, unknown or other
  misc_feature (214)..(214): n is a, c, g, or t
  modified_base (355)..(355): a, c, t, g, unknown or other
  misc_feature (355)..(355): n is a, c, g, or t
tcagatagagtactcacgaccggtgctcgattagtgtcgtcgcaagagagagggggtggagtcaggacttctcagttcatcttctcaccatgaggctccctgctcagctccgtgggctgctatgctcnggataccnggactcagtggagntatganatcgacccagactccactctctctgtccgtcaccctggcacgccggctccatcctccncgacacgtctagcagacgccgtcgtgctagtcgtgataggaaacgctaatagtgtaccgtagtacccgtagacaaggtaactcgacggtaccacgtcctaccacggacctctacgtattagtacgaacgtttacaacgttnttacgttttaggcgtactcgaagtacgtacgactaggacgtcggacggacggtcgggtacgacggtacgagttacttacgacgttaacgtaaggtaaacctcgtaacggggtacccggtagggtaccgggacgtacgggacgggttaagtcgggttcgtaacggttacggttttaagttaacgtttccgtagttaacgtcgtaaacgttaacgttacgttaagtccgtttaacgttattaccggtttacgaccggttacggtaccttcggtacccgtagggtactacggtacctaaaccgg

SEQ ID NO: 105562 - DNA, 678 bp, Homo sapiens
  misc_feature: GYAE6OF02JDOKX.29.71.G05.1.454.CMB.1.raw
  modified_base (212)..(212): a, c, t, g, unknown or other
  misc_feature (212)..(212): n is a, c, g, or t
  modified_base (329)..(329): a, c, t, g, unknown or other
  misc_feature (329)..(329): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtggtgctgtccttgctaatcgctctggatacctggatccagtggagatagttgagatcgacccagacctccactctcgtctcgttccgtcctaccccgttgaccncggcccggtcccttccgactcccgtccttcgacctaaacgttccgtagtccgaggaccgtccccgttacggtcgtaccagttacggtcggtaagttaaccgggaaaacgtacccttaaattacgtacgtttaccggtacgggtacccttggaccggtaaacgtaaggttcccgaaggtcccgtacggccccgttacccgaacccgtacccgtaccgttagttaacgttttagtacggttaaacgtttacccgaaagttcggttttatttacgggacgtttccggaccctaaggaccttaggtacccttaccgtaggtaccggaggtaccggtacggggtacgtaacggg

SEQ ID NO: 105563 - DNA, 710 bp, Homo sapiens
  misc_feature: GYAE6OF02HHP0T.29.71.G05.1.454.CMB.1.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtnatggaaanactatatgtactgtacctgacagaagtcaggccagcctacacgtactcctgtactttatacgtaagttccaaaggttcgtttaagttttggacgttcgaccgtaagaaccgtagggtccttacgaacggttcgggaccgtacgggtaccggggttacggaaggggtaacccaaggttaacttttacccgaaacgttaaccgtaaacggtaaaaaacgttccggtaaacggggtcccggggttagggaacgggtccgttaagggaagggttaacgttgggtttacgggtactttaagttttaagtttacgttacggaccttaagttacggtaacctttaaaggttttacctacggttctttacggtttaccttaaccggtttttaccggggacccggtaaccgggggtaaccctacggtttacccggtaacggtaacccgtaagttaaacccggg

SEQ ID NO: 105564 - DNA, 766 bp, Homo sapiens
  misc_feature: GYAE6OF02IUWGF.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctcgtgtccgtccacccctggacagcccggcctccatctctgacaagtctagtcagacgcctgtgactatagtagagtaggaaagtacctaatatagttacgtacggtacctgacaaggaacgtccgacggaccaacggtccctaccgaaccgtaccttccgtagttaacttttagtacggttaaaccgttttaacctaaccggtttacggttttaagttttttagggaacggttacgtacccgaaaggtaacccgtaagggtcccttacggtacgggttacgggacccggtaggggtaacccgggggtccggtaaacggggaaccttaacgggttaacttttaacccgaaaccgtaaaccggtaagtaaaaacgttccggaacgggggttacccgggggtaggaaccgggtccggtaagggtaacgggttagttacgggtttacgggtaattttacgttttaacgtttagttacgtacgttaagttaacgtaacggttaaactttcggacggttcgttacgtttacgttacgtttacggaccggtacgggtacctaccgttaccgtacggtacctacgttaaaccgg

SEQ ID NO: 105565 - DNA, 698 bp, Homo sapiens
  misc_feature: GYAE6OF02H520A.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcgagggtgctgctgaggctgtaggtgctgtccttgctaatgctctggacttaccgtggactccgaggtggagtattagttagagtatacgacccagtacctaccaccttcctcctccgttcgtcccgtccctaccccgttcgaaccgaccgggtccccggtcccttccctacttcccttcccgtacgaccgtaacgttcgtacgtacgaacggtaccgtcccgttcggtcgtaccgttagtacggtaggtaacgtaacgggtaaaacgtacccttaagttacgttacgttaccggttacggtacccgtaggaccgtaaggacggtaccgaacgggcccaccgtaccctaccgaaccgtacccttcgttacgtattttaacgttaggttaaaccgtttaccgaaggtttacgttttaggtttacggacgtcggaccctaggaaccgtacggtctacggaaggtccggacggtacgggtccgggtacgtaacggg

SEQ ID NO: 105566 - DNA, 663 bp, Homo sapiens
  misc_feature: GYAE6OF02IZT89.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctggaggctgtaggtgctgtccttgctaatgctctggatacctggactccagtggagtatatgagtatcgacccagacctccactctctctgtccgtccacccgtggacacggcccggcctcactcctcctgactaagtctagtcagtacgcccttcggtcactagtacggtacgtaagtaagggaaaacgtaccctaagttaacgtacggttaaccgttccggtaaccgttagaacgtacggtaaacgtaccgaacgggacccacgacccgtacccaaccgtacctcccgttaacggttacttttaacgttaacggttaaaccgttttaaccgtaacggtttaccgttttagtttttagggacgttcgggtaacccgtaaggtaacggtaccggtaccttacggtacgggttacggaccggtacgggtaccgggtaccgtaacgggg

SEQ ID NO: 105567 - DNA, 616 bp, Homo sapiens
  misc_feature: GYAE6OF02G8VV0.29.71.G05.1.454.CMB.1.raw
  modified_base (435)..(435): a, c, t, g, unknown or other
  misc_feature (435)..(435): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcaccctggacagccggcctccactctcctgcaagtctagtcagacgcctcgtgcatagtgataggaaagacctatatgtactggtacctgacagaagtcaggccacgcctaccgacgacctcctgtatttatagtaacgtttaccaagttcgtttagttttgggatcggaccagacgacggctcgaggtggcgacggcgggtcaggggacagtatttcgaactataacggaaatcggacggtccggggngaacgggtcgtaggagggtagttgggttacggtactttatttaagtttacgttgtactaagttacgtaacgttaaaaggttttcgaagttacggtttggttaccctttaagggttttcggaacccggtaagggggtacccttacggttccgtaacgggtaccttagtaacccgtaaaacgg

SEQ ID NO: 105568 - DNA, 706 bp, Homo sapiens
  misc_feature: GYAE6OF02F2K9K.29.71.G05.1.454.CMB.1.raw
  modified_base (237)..(237): a, c, t, g, unknown or other
  misc_feature (237)..(237): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacacgccggccctccatcctcctgacagtctagtcagacncctcgtgctagtagtgataggaaactacctatatcgtacgtggtacctgacaagaacgtcgacggccagtcccctacgaccgtacctcctagtacttttagagttaaacgtttcccaaaggttccgttttaggttttcggacgtcggccaaggtaccaggtcctacgaggtcggcggacggtcgggtacgagggtactagtatttaccgactaacgtaacgtaaaacgtccggtacgggtaccggggtagggtacggtaccgtagggaacggttacgggttacgggtttacggaccgttttaaagtttttacgtttaacgtttacgtaccgttaagttacgttaaactttaacgggtttacctacggttacggtttacggttttaccggtttaaccggttttcggggaacccggttaaccggggttacctaccggtttaaccggtaccgggtaactacgttaaacccgg

SEQ ID NO: 105569 - DNA, 669 bp, Homo sapiens
  misc_feature: GYAE6OF02GC4A3.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctgggctgctaatgctctggatacctggatccagtggagatattgagatgaccagactccactctctctgtccgtcacccctggacagccggcctccactctcctgcaagtctagtcagagcctcgtgcatagtgataggaaacgacctatatgtactggtacctgcagaagtcaggccagcctcacgactcctagtatttatagtaacgtttccaagttcgtttagtttaggagttcgaccgaagtaccgacgggtccttacggacggtttcggacgtacgggtccggggtacgtaacgggaacgtaagtactttaccgaactaacgttaacgaaaacttcggaacggtccggggttaggacgggtcgttaggaagggtagttgggttacggtacgttaagttttaatttagttcgtacgtaaggttacgtaagttaaacgtttacgtacgttacggtttcgtttaaccgttaccggtttttacgggaaccccggttaaggggtaacccttaccggttacccggttaggtaaacccttaagtaacccgtaaaacccggg

SEQ ID NO: 105570 - DNA, 816 bp, Homo sapiens
  misc_feature: GYAE6OF02JLMO3.29.71.G05.1.454.CMB.1.raw
  modified_base (244)..(244): a, c, t, g, unknown or other
  misc_feature (244)..(244): n is a, c, g, or t
tcagatagagtactcacgaccggtgctcgatttagtgtcgtcgcaagagagagggggacgtgatcaggacttctcagttcatcttctcaccatgagctcctgctcagctcctggggctgctaatgctctggtactacctggtactccaaggtgggagatattgagagtgaccagactccactctctctgtccgtcaccctggacagccgcctccactcctcctgctaacgtctaggtccagacncctcgtgcatagtcgagtaggaaacgaccttaatagtacgttacgttcgggttaacctggtacgaaggtaacgtaccgtaaccggggccctaacggtacccctacccggaaccgtaccccgttcccgttaaacgtacgtttttaaacgtacggttaaaccggttttaacccgtaaaaggtttccgtttttaaagggttttttacgggaacggtttcgggtacccctagggaaacccggttacgggtaccttccgggtagggttacgggcgttaacggggtcccgggggttacggaacggggtaacctaggtttaaactttcccgaaacgtaacgtaaacgtaaacgttacggacgggttaccggggttagggaccggtagtcgggaacgggttaaggttccggtttaagggtaccttttaaggtttttaacgtttaggttacttaagtacgttacgttaaccgttaagttttaaccgaggttcgttacgttttacgtttaaccggttttaccggtagggttaccgggttaaccgtaccgttaccggttaagggtaccttaacggtaacccgg

SEQ ID NO: 105571 - DNA, 693 bp, Homo sapiens
  misc_feature: GYAE6OF02H4F1X.29.71.G05.1.454.CMB.1.raw
  modified_base (248)..(248): a, c, t, g, unknown or other
  misc_feature (248)..(248): n is a, c, g, or t
tcagatagagtactcacgaccggtgctcgatttagtgtcgtcgcaagagagagggggactgatcaggacttctcagttcatcttctcaccatgaggctccctgctcagctcctgggctgctaatgctctggatacctggatccagtggagatattgagatgacccagactccactctctctcgtccgtccacccctggacagcccggcctccatcctcctgactaagtctagtcagacggcccttcgngcattaggtgaagtaggaaaacgtaccttaattagttacgttaacgttacggtaaccctggaccgaaggtaaaccggttcaacgggacccacggtcccctaccgaaccgtaccttccgtagttatttagtacgttaacgtttaccaaaggttccgtttagttttaggacgtcgaccgtaagacgtacggtctacgacggtggacgacgggtcgggtaccgaaggggtacaggttacttacaaacgtacgtaaagaaacgttcggaacgggtccggggtagacgggtcgtagggtaggtagtttgggttacgtaactttaagttttattagttcgacgttaagtcgtaaacgttaagtttacgacggtttcgttaacgtttacgttacggtttaccggaacggtacgggttaaccctgttaacccggaggtaacctcgtaaaccgg

SEQ ID NO: 105572 - DNA, 581 bp, Homo sapiens
  misc_feature: GYAE6OF02GXV86.29.71.G05.1.454.CMB.1.raw
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggtctgtaggtgctgtccttgctaatgctctggactacctggactccgagtggagattagttgagatcgacccagacctccactctctctcgtccgtccacccgtgacacggcccggccctccacttcctccncgactagtctacgtcagacgtcctcgtnctagtagtacgtagtacggaaacgtacctaagtagtacgttacgtcggttacgcgacaagtacgcgacggccacgccctaccgaccgaccttcgtagtttacttagttacggtaactttaccgaagttcgttttagtttaggacgttcgaccgtaagccgtacggtcctagacggtggaccgtagggtccggagtaacggg

SEQ ID NO: 105573 - DNA, 644 bp, Homo sapiens
  misc_feature: GYAE6OF02ICT47.29.71.G05.1.454.CMB.1.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
tcagatagagtactcacgaccggtgctcgatttagtgtcgtcgcaagagagaggggactgatcaggacttctcagttcatcttctcaccatgaggctccctgctcagctcctggggctgctaatgctctggatacctggatccagtggagatattgagatgacccagactccactctctctgtccgtccacccctggaccagcccggccctccatcctcctgacaagtctagtcagagcctgtgcatagngatggaaanacctatagtgtatcggtacctgcagaatcgaggccagcctccacgtactcctgtatttagtagtaacgtttacaagtcgttttattttggagtgaccagacgaggtctcgaggtcggacgacgggtcgggtcgaacgggacgtagtaacgtttacgacgtaacgtagaaaacgttccgaagggtccggggttaagggacgggtacgtacggaaggtacggttaggttagggtactttaagttttagtttaagtttgaccgtagttacgtaacttaaacggtttaactaggttacgtttacggttacctttaaccggtttttacggaacccggttacggggtaaccctaacgttacccggtacggtaacccgtacgttaaacccgg

SEQ ID NO: 105574 - DNA, 618 bp, Homo sapiens
  misc_feature: GYAE6OF02FNH8U.29.71.G05.1.454.CMB.1.raw
tcagatagagtactcacgaccggtgctcgatttagtgtcgtcgcaagagagaggggggactgatcaggacttctcagttcatcttctcaccatgaggctccctgctcagctcctggggctgctaatgctctggatacctggatccagtggagatattgagatgacccagactccactctctctgtccgtcacccctggacacgccggccctccatcctcctgcaagtctagtcagacgcctcgtgcatagtgataggaaagtacctaatattgtactggtacctgcagaagtcaggccagccctaccaccgacctcctagtatttatagtaagtttaccaagtcgtttaagttttggagttgccaagacaggctacgaggtggcgaggcgggtacgaagggacagtactttacgaactacgtaagaaactcgacggcgggtaggacggtctgggaggtagttaggttacggtacttaagttttaagttagttagtactagtgtaaacttaaacggttacgtacgttcgtttaggttaaccgttaacggttttacgggacccggttaacggggtaacccttaacgttacccggtaacggtaaccctaagtaaaccccgg

SEQ ID NO: 105575 - DNA, 750 bp, Homo sapiens
  misc_feature: GYAE6OF02J2NME.29.71.G05.1.454.CMB.1.raw
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
tcagatagagtactcacgaccggtgctcgatttagtgtcgtcgcaagagagagggggactgatcaggacttctcagttcatcttctcaccatgaggcctccctgctcagtctccgtggggctgactaatgctctaggactaccgtggatccgagtaggagtatattgagatcgaccagacctccnctctcctntccgtacctccacccgtgaccncggcccgtcctccacttctaccgtgtaccaacgttcgtagtccgacgcgtcctacggtcatacgtgtacgaacgttacggaacgttacttagtacgttacttaccgttacggacctacgacgttaaacggacgtcgccggtaaccgccgtaccccttaccgaaccgttccccgttaggtagtttaactttacggtaacgtttaacgttttaccgaaggttttggtttaaacgtttcggacggtaccgacgtaagttacccgaagggtttcccaagggtacggttacgggacgtacggggtccgggtaacggtaaccgggtaagttaacgttaccgtactaaacggaacgtaaacggtacgacggtacccgggggtagtacgggtacgtggacgtaaggtcgtttagttcgtaacgtttagtttaatcgtctagaagtttacggtaattacgtacgttgttaacttcggttaccgttagttaccgggtaccgtacggtacctaccggttaattacccggaggttaaccctaaccgg

SEQ ID NO: 105576 - DNA, 663 bp, Homo sapiens
  misc_feature: GYAE6OF02JAWPE.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacagccgcctccatctcctgacaagtctagtcagcgcctcgtgcatagtcgatggaaagacctatatgtactggtacctgcagaagtcaggccacgccctccacgtacctcctagtatttatagtaacgtttccaaagttcgtttagttttcggagttcgaccgtaagactagggtcctcgaaggtcgggacgaggggtccgggttacgaagggggtaactacggttaacttttaccgaacctaacgttaggtaaaaaccttcgaacgggtcccgggggttagggacgggtccggtagggaacggggtaagttcgggtttacggtacgtttaagtttttacgtttattttcggacctaagttcgtaacgttaaggttttacacgggttctttacggtttacttaaccggttttggaaccgggtacgggtaaccttacgttccggtacggtaccctagttaaacccg

SEQ ID NO: 105577 - DNA, 831 bp, Homo sapiens
  misc_feature: GYAE6OF02I1UIS.29.71.G05.1.454.CMB.1.raw
  modified_base (260)..(260): a, c, t, g, unknown or other
  misc_feature (260)..(260): n is a, c, g, or t
tcagatagagtactcacgaccggtgctcgatttagtgtcgtcgcaagagagagggggtgatcaggacttctcagttcatcttctcaccatgaggctccctgctcagcctccgtggggctgactaatgctcgtggatacctggatccaggtggaagtatattgagtatcgacccagacctccactctctctcgtccgtccacccgtggaccacggccgtcctctactcctcgtgactaagtctagtcgagtacgtcctgtnactagtagtagaagtaggaaactacctaatacgtacgtacgttcggtactagacgaaggtacgtaccgacggtccacgtccctaccgacgtacctcgtagttagttacgtacggttaaccgttacgtaacggtttcgtttagttcgggtacgtacgaacgtagtacgtacgtacgtacggtaggtacggtacgtaacggggtcgggtaaacggaacgggttaacgtacgtttaacttaaccgaaaccgttaacggtaaacgtaaaacccggttcgggtaaccgggggttaccgggggaagaaaccggggtttcgtaaagggtaacgggggtttaccgttttagggggttacgttaaactttttaacgtttttaaagttagggtaacctttaaggtaaacggttttaacgtaaaaccggttttaacgttacccgggtacgttttacgttttacccggtttaaaccggggtttggttaccccgggtaaacccgggtacccggggtttaccctaaccgggttttaaccccgaaggggttaaacccttaacccggggtaaccgttaaaacccggg

SEQ ID NO: 105578 - DNA, 529 bp, Homo sapiens
  misc_feature: GYAE6OF02FS0D3.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagcccggcctccatctcctgcaagtctagtcagagcctcgtgcatagtgatggaaagacctatatgtactggtacctgcagaagtcaggccagcctcacgactcctgatttatgtaagtttccagtcgttattttggagtgccagacaggctcgagtggcaggcgggtcagggacagtatttcaacactagaaatcgaggccgggtggaggcgtaggaggattggttaggcttatttattagttgtctagtgactaagtttacagtcgttgttcttacgttttcggaccgtaggggtacctacgttaccgtggtacctagtacgtaaaccgg

SEQ ID NO: 105579 - DNA, 622 bp, Homo sapiens
  misc_feature: GYAE6OF02GE657.29.71.G05.1.454.CMB.1.raw
  modified_base (324)..(324): a, c, t, g, unknown or other
  misc_feature (324)..(324): n is a, c, g, or t
tcagatagagtactcacgaccggtgctcgatttagtgtcgtcgcaagagagaggggggtgatcaggacttctcagttcatcttctcaccatgaggctccctgctcagctcctggggctgctaatgctctggatacctggatccagtggagatattgagatgacccagacctccactctctctgtccgtcacccctggacagccggcctccatctcctgcaagtctagtcagacgcctcgtgcatagtgataggaaatacctatatgtactcggtacctgacgagaagtcgaggccacgtccctaccgacgactcctgtatttanagtaacgttacgaagtcgtttagtttggagtcgaccagacgaggctagaggtggacgagggtcgggtacgaagggactagtattacaactacgtaacgaaactcgaacggccggggtaggacggctaggaggtattgggtcgtactttaagttttaagttacgtacgtacgtaagttacgtaacgttaaacgtttacgaacgttccgtttagttaccgtttaccggttttacggaaccggttaacggggtaacccttacgtacccggtaaggtaacctaacgttaaccgtaaaaccgg

SEQ ID NO: 105580 - DNA, 549 bp, Homo sapiens
  misc_feature: GYAE6OF02FSS8U.29.71.G05.1.454.CMB.1.raw
tcagatagagtactcacgaccggtgctcgatttagtgtcgtcgcaagagagaggggggtgatcaggacttctcagttcatcttctcaccatgaggctccctgctcagctcctggggctgctaatgctctggatacctggatccagtggagatattgagatgacccagactccactctctctgtccgtcacccctggacagcccggcctccatctcctgcaagtctagtcagagcctcgtgcatagtgatggaaagacctatatgtactggtacctgcagaagtcaggccagcctccacgacctcctgtatttatgtaagtttaccaagtcgtttattttggagtcgccagacgaggctacgagtggacaggcgggtcgagggacgtagtatttacactacgtagaaactcgaggccggggtaggagggtcgtaggaggtagttggtgtactagttttattagttgactagtcgacgtaagtttacgagtcgtgttccttacgtttcggacgtacggggacctagtccgtaggactacgtacgtaaacgg

SEQ ID NO: 105581 - DNA, 633 bp, Homo sapiens
  misc_feature: GYAE6OF02IA9EJ.29.71.G05.1.454.CMB.1.raw
  modified_base (237)..(237): a, c, t, g, unknown or other
  misc_feature (237)..(237): n is a, c, g, or t
  modified_base (566)..(566): a, c, t, g, unknown or other
  misc_feature (566)..(566): n is a, c, g, or t
tcagatagagtactcacgaccggtgctcgatttagtgtcgtcgcaagagagaggggactgatcaggacttctcagttcatcttctcaccatgaggctccctgctcagctcctgggctgctaatgctctggatacctggactccagtggagatattgagatgacccagactccactctctctgtcctccacccctggacacgcccggcctccatcctcctagactaagtctagtcagngcctcgtgcatgtagaactaggaaacgtacctatattacgtactacggtaccctgaccgagaacgtcgacggccagccctcgaactacctctgtatttgtaagtacgtttcgaaacgttcgtttattttggagttcgccgaagtacgaggtcctagtacggttcggacgacgggtccgggtacgaacgggtactaggttacttccgaaactacggtaagaaaacttcggaaggtccgggttaggacggtagtggaagggttacttgggttcgtaagtttagttttaacgttagtacgacgtagttcgtaaactaagttttacacggttnttaaccgttgttacccggtttagaccggtacgtaaccgttctaaccgtcggtacctaagtaaacccg

SEQ ID NO: 105582 - DNA, 772 bp, Homo sapiens
  misc_feature: GYAE6OF02IK5U0.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgaacccagactccactctctctgtccgtcacccctggacacgccgcctccattcctctgaccaagtctacgtcagacgtccttcgtgctaagttagtgaataggaaaacgtacctaatagttgtaactggtaccctgaccgaaggtaacgtcacggacctaggccctaccgaacgtaccttcctagtattttagagttaacgtttaccgaagttcgtttaattttgggagtcaaccgagacgtagtccttacgagggttcggacgtacggggtacgggtacggaacgggtactaacggttactttaccgaaaccgtaacgttaacgaaaaaccgttaccggaacgggtacccggggttaagggtacgggtaccgtaggggaacggtttaaacgttgggtttaacgggtaaccgttttaagtttttaaggtttaacggtttaccgtaaccggttaaagtaccggttaaaaccgtttaaaggttttaaccgtaacggtttaccgttttacgggttttaaccgtttaaccgggttttacccgggacccggttaaacggggttaccctacgggttacccggtaaccggtaaccttaccggtaaacccgttaaacggg

SEQ ID NO: 105583 - DNA, 673 bp, Homo sapiens
  misc_feature: GYAE6OF02GB2NW.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctccgtggggctgctaatgctctggataccgtggatccagtggagatattgagatcgacccagactccactctctctcgtccgtccaccccgtggaccagcccggtcctccattcctcctgacaagtctagtcagacgtccctcgtgactagtaggtgaagtaggaaacgtaccttaagtacgttcgtaacgtacggttaccctggacaaggaacgtcgacgggcccagtcccctacaccgtacttcctagtatttatacgtaactttacgaggttcgttttagttaggagtcgacgagtacgtaggtcctagtcggtacggccgtacgggcgggtacgaagggactagttacttaccaacgtactaagaaacgtcggacgggtccggggagacggacgtaggaggtgttggttaggtatttaagttttagttgttacacgtagttacggtaacgtttaaggtttcgacgtttacgtttcggtttactttacccgggtttacgggaacccggttaacgggtaacccttcggtacccgtaagtaaccgttaccggtaaccgtaaacgg

SEQ ID NO: 105584 - DNA, 593 bp, Homo sapiens
  misc_feature: GYAE6OF02ITY9V.29.71.G05.1.454.CMB.1.raw
  modified_base (318)..(318): a, c, t, g, unknown or other
  misc_feature (318)..(318): n is a, c, g, or t
tcagatagagtactcacgaccggtgctcgatttagtgtcgtcgcaagagagaggggggtgatcaggacttctcagttcatcttctcaccatgaggctccctgctcagctcctggggctgctaatgctctggatacctggatccagtggagatattgagatgacccagactccactctctctgtccgtccaccctggacagccggcctcatctcctgcaagtctagtcagacgcctcgtgcatagtgataggaaagacctatatgtactggtacctgcagagtcgaggccagccctccaccgactcctagtacttttanagttaacgtttaccaagttcgttttagttttgggagttgacccgaagacgacggtcctacgaggtgggcgagggtcgggtacgacgggactacgttattcgaactaacgtaagaaaactcgaacgggtcggggtaggacggtcgtaggaggtgtgttcggacttatttagttattgactagttacgagttaagtttcaagttccgttcgtttacgttacgtttcgggaccggtaagggtaccctacggttaccgtaggaacctataccgtaaacg

SEQ ID NO: 105585 - DNA, 614 bp, Homo sapiens
  misc_feature: GYAE6OF02HM5EZ.29.71.G05.1.454.CMB.1.raw
  modified_base (212)..(212): a, c, t, g, unknown or other
  misc_feature (212)..(212): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgctgtccttgctatgctctggatacctggactccaggtcggagtatattgagactgacccagactccactctctctcgtccgtcctaccccgtggaccacggcccggtccctccactccttcctcgactaaacgtcgtaggtcacgtagcccttcgtgactagtagtgatagggaaacgtaccttaatatacgttactggttaccctgcgaacgtagtaccgacggcccacgtccctaccgaccgtacctccgttagttaacttttacgtacggttaacgtttaccgtaacgttacgttttacgttttagggaggttccgaccgtaacgtacgaccggttccttacggaagtcggtacggtacgggtaccgggtacggaaccggg

SEQ ID NO: 105586 - DNA, 771 bp, Homo sapiens
  misc_feature: GYAE6OF02ICICK.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctgggctgctaatgctctggatacctggatccagtggagatattgagatgacccagactccactctctctgtccgtccaccccgtggacagcccggcctccactcctcctgactaagtctagtcagacgcctcgtgccataggtgataggaaactacctatactgtactcgggtaccctggactagaacgtcgacggccagtccctaccaacgtcctcgtagtactttagtcgtaacgttaccaaggtctttaaggttttggaacgtcgaccgtaagtacgtaacgggtccttacggaagggtcggacgtacggggtccggggttaacgaaggggtacccgtagttacttttacccgaaaacggttacgtaaacggtaaaaacgtcccggtaacgggggttcccgggggttaagggaaccggggttacctaaggggttaagggtaccggttttaagggtttacgggtaaccgtttaaagttttttaaccgttagttttaaccggacttaaacgggttcgtaaacgggttaaccttttaccggacggttttacctttaacggttttacccggtttaaccgggttttaaccggacccgggtaaacggggttaccccttaaagttccccggggttaagtaccccggtaactttaaaacccggg

SEQ ID NO: 105587 - DNA, 574 bp, Homo sapiens
  misc_feature: GYAE6OF02F6MAG.29.71.G05.1.454.CMB.1.raw
tcagatagagtactcacgaccggtgctcgatttagtgtcgtcgcaagagagaggggggtcaggctggaactgaggagcaggtggggggcacttctccctctaacactctcccctgttgaagctctttgtgacgggcgagctcaggccctgatgggtgacttcgcaggcgtagactttgtgtttctcgtagtctgctttgctcagcgtcgagggtgctgctgaggctggtaggtgctgtccttgctaatgctctggatacctggatccagtggagtatagttgagatgacccagactccactctctctcgtccgtccaccccgtggacacgccgcctcctatcctcctgaccaagtctagtcacgacgtccgtgtcgcagtagtagaagtaggaaacgtactattatcgtacgtcggtacctgacaagtaacgtcgacggtccacggtccctaccgaccgtacgtcctagttatttagtataacggtttaccaagttcgtttagtttggagttcgaccgtaaggtaccgtaggtcctacggtacggtcggacggacgggtacggtacgaacgggg

SEQ ID NO: 105588 - DNA, 634 bp, Homo sapiens
  misc_feature: GYAE6OF02F6NW1.29.71.G05.1.454.CMB.1.raw
  modified_base (333)..(333): a, c, t, g, unknown or other
  misc_feature (333)..(333): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatgacccagactccactctctctgtccgtccacccctggacagcccggcctccatcctcctgcaagttctagtcagacgtcctcgtgctatagtgagtaggaaacgacctatatgtacttcggtacctggcaaggaacgtcgacggccagtcccctaccaccgtacctccgtntaacttttagtcgtaaacgtttccgaagttcgttttagttttggagttcgaccgtaagacgacggtcgtacaggtcggacgtacgggtcgggtacgaggggtaactaggtacgtttacgaactaacgtaagtaaaacgtcgtacgggtcccgggtagggtacggcgtagggaggtagttggttggtactttagttttagttagttcgatagtacgtaagttaagttacgagttacgttagttacgttacgtttcggaaccgtacgggtaccttaccgtacgtacggtactaactaaaccgg

SEQ ID NO: 105589 - DNA, 697 bp, Homo sapiens
  misc_feature: GYAE6OF02IRFI7.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtccaccctggacagccgcctcatcctctgacaacgtctagtcaagacgccttcggtgacattaggtcgaagtacggaaaacgtaccttaatattacgtaacgtggtaaccctgactaaggaacgtcgaacggaccacgccctaccaaccggacttcctagttaatttagacgtaacgtttacccaagtttcgttttaacgtttgggacgtcgaccgtaagaacgaccgggtctacgtcgggtagacccgtaaggggtcggtaacgggaaggtacaggttaacctttacgacctaacgtaaaggtaaactcggtaacggggtaccgggagggtacggtacgtaggaacgggtgttacggttaggtactttaagttttaagttcgtacgtactagtactaacgttaagtttagtcgttacgtttacggttaacgtttaccgggtttaccgggtaccggaacggggtttaacctaccggttcggtaaacggccttaaacggtacccgtaaacggg

SEQ ID NO: 105590 - DNA, 710 bp, Homo sapiens
  misc_feature: GYAE6OF02H8Q3S.29.71.G05.1.454.CMB.1.raw
  modified_base (182)..(182): a, c, t, g, unknown or other
  misc_feature (182)..(182): n is a, c, g, or t
  modified_base (201)..(201): a, c, t, g, unknown or other
  misc_feature (201)..(201): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggataccgtggactccaggtggagatattgagatcgaccagactccactctcnctgtccgtcacccgtgacncgccgcctccatctctgacagttcctagcaagcgtccgtcgtgacagtagtgagtaggaaacgacctatagtcgttacgtacggtactgacgaagaacgtcgacggaccacggccctaccaccgtactccgttagtaacgttttagtacggttaaacgtttacgaaacggttttcgttttaaggtttttacgggaacgttacgaccgtaacggtaacgtacgtaccgttcggaagggttcggacgtaccgggtacggggttacgaaaggggtacctaagggttactttaccgaaacgtaaacttaaggaaaacgtcgtaacggggtaccgggtagggaccgggtactagggaacgtgtttacggggttacgtaagtttaagttttttaaccggtattacggttacgttaacgttaacggtaagtttaaacctacggttcgtacgtttcgtttacgttacggttccggacggtacggtctaacgtcgtaacggactacgtacgtaaacgg

SEQ ID NO: 105591 - DNA, 572 bp, Homo sapiens
  misc_feature: GYAE6OF02IV6I6.29.71.G05.1.454.CMB.1.raw
  modified_base (309)..(309): a, c, t, g, unknown or other
  misc_feature (309)..(309): n is a, c, g, or t
  modified_base (495)..(495): a, c, t, g, unknown or other
  misc_feature (495)..(495): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccgcctcatctcctgcaagtctagtcagacgcctcgtgcatagtgataggaaagacctatatgtactggtacctgcagagtcaggccagcctccacgactcctgatttangtaacgtttccaagtcgttagttttggagttgccagacaggctacgagtggcgaggcgggtacgagggacaggtactttacactaacgtaagaaaactcgaaggtcccgggtaggacgggcgtaggaggtagtggttaggtctaatttttaagttattcggtctagttacgtaattaaacgtttanagttcgttaggttttactacggttttcggaccgtacgggtacctacgttcccgtacggactacgtaccgtaaaacgg

SEQ ID NO: 105592 - DNA, 576 bp, Homo sapiens
  misc_feature: GYAE6OF02HSHSI.29.71.G05.1.454.CMB.1.raw
  modified_base (238)..(238): a, c, t, g, unknown or other
  misc_feature (238)..(238): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagtatgacccagacctccactctcctctgtccgtccaccccgtggaccagccgcctccatctcctgacaagtctagtcagncctcgtgcatagtgataggaaagtaccctatattgtacttcggtaccctgtcaagtaacgtcaggcccagccctaccacgactcctgatttatgaactttcaagtcgtttagtttgacgtcgaccagacaggtctagagtggcaggcgggtacgagggactagtctttacaactactaagaaaactcgaacggccgggtaggacgcgtaggacggtatcggttagacttaagttttattattgactagttacgacttaagtttaccagtcttacggttaccttacggtttcggaccgtaagggtaccctagttacccgtacgtaaccacgtaaaccgg

SEQ ID NO: 105593 - DNA, 720 bp, Homo sapiens
  misc_feature: GYAE6OF02G0936.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactcctctcgtcgtccaccctaccgtcgacgacggcccgtcctactacctcctcgtcgacgttactcgtacgtacgagtccgtccgtcgcgactagtagtagtagtaaggaactatatagtcgtacgtcgtcgacgacgtaagtacgacgcgaccgtccgtaccctaccgtaccgtccttacgtagtttactttaggtacgtttaaccgttacgtacgtttacgttttaggttaggtaacgtccggtaaccgacgtaacgggtctaccgttacggtacgggtcggacgggtacgggtaccgggtaagggtaccggtaaacttaacggttacgttaacctaaacgtaacgtaaaaccgtacgtaccggggtaccggggtacggggtagggacggttacggaaggttagggtcgtttacggttacggttaattttagttagtcttacgagttactaagtaacgttaagtgtacgttgtttacgttagttttaccgggacggtacgggtacccttacgttacgtaccggactaacgttacgtaaacgtacgg

SEQ ID NO: 105594 - DNA, 636 bp, Homo sapiens
  misc_feature: GYAE6OF02IOHKU.29.71.G05.1.454.CMB.1.raw
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggactacctggatccagtggagatattgagatcgacccagacctccactcctctctcgtcccgtccaccccgtggacacgcccgcctccatcctctgacctaagtctacgtcaagtacgccgttcgtgctagtaggtnagtaggaaacgtacctagtatcgttacgtgtacctgacaggtaacncgaggaccncgccctacccgacgtaccttccgtagttaatttacgtaggtacgtttaccaagttcgttttaaggtttggagtcgacgacganacggctagaggtcggcgaggcggtagacggtanaggtacttacactaacgtaanaaacgtcgaacgggtacggggaggtaggtacgtaggagtgttaggtagtactttatttacttgtgacgtagtagtaacttaaggttacgacgttcgttacgttactttacgggtttacggaccgggttaacggacccttaacggttccgtaaggtaccgtaacgtaaccgtaaccgg

SEQ ID NO: 105595 - DNA, 582 bp, Homo sapiens
  misc_feature: GYAE6OF02F1SBL.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctgtgcaatagtgaatggaaagcctatatgtactggtacctgacagaagtcaggccagccctaccgacgcctcctgtatttatgtaacgtttccaagtcgtttatttggagtcgccagacgaggctagagtcggacgacggtcgggtacgaagggtacagttacttaccaactaacgtaacgaaaacgttcgaacggtccggggtagggacggtcgtaggaggtagtggttacggtcgttaattttagttagttcgctagtagtaactaagtttacagtcgttagttacgttacgtttacggaccgtaacgggtacctacggttccgtaggacctacgtaacgtaaacgg

SEQ ID NO: 105596 - DNA, 781 bp, Homo sapiens
  misc_feature: GYAE6OF02I8SBN.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccaggtggagatattgagatgacccagacctccactctctctgtccgtccacccgtggacacgcccggtcctccactcctccctgacctaagttctagtcaggacgcctcgtgacattagtgaatacgggaaataccttaattagtacgtacgttcgggtaccctgacgtaaggaagtccgaacggcccctaacggccccttacccgaaccggttacctcccgttagttaactttttaacgtacggttaaacgttttaccgaaggttacgtttttaagttttgggaacgttcgacccgtaaggacccgtaagggtccttacggacggttacgggacgtacgggtaccggggtaccgtaaggggaactaggttaacgtttaccgaactaacgtaaaggtaaaaccttccggaacgggttcccggggtaggaccgggttacaggggtaacggttagttgggtttaccggtaacgtttttaagttttaagttttaacgtcggtaccgtttaaagtaccgtttaagttaaaccggttttacaacggtttcgtttaaccggttacttttaccgggtttacgggggaacccggttacgggttaacctaccgttccgggtaaggtaacccttaacgtaaacccgg

SEQ ID NO: 105597 - DNA, 611 bp, Homo sapiens
  misc_feature: GYAE6OF02GJ5HK.29.71.G05.1.454.CMB.1.raw
  modified_base (256)..(256): a, c, t, g, unknown or other
  misc_feature (256)..(256): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctgacaagtctagtcagacgcctcgtgcatagtgataggaaanacctatatgtactggtactgcagagtcaggccagccctccacgcctcctgtatttatgtaacgtttccaagttcgtttagtttgggagttcgaccagacgagtctacgaggtcggacgtacgggcgggtacggacgggactaagttacgttacaactaacgtaagaaacgtccggaacgggtcgggtagggacggtacgtaggaaggttgttggttacggactttagttttagttagttgacgttagtacgtaacgttaagttacgtacgttcgttacgtttcgtttacggtttacgggacccggttaacgggaccttaccgtaccggttacgaaccgtacgtaaccgtaaacgg

SEQ ID NO: 105598 - DNA, 555 bp, Homo sapiens
  misc_feature: GYAE6OF02G92FR.29.71.G05.1.454.CMB.1.raw
tcagatagagtactcacgaccggtgctcgatttagtgtcgtcgcaagagagagggggaatgatcaggacttctcagttcatcttctcaccatgaggctccctgctcagctcctggggctgctaatgctctggatacctggatccagtggagatattgagatgacccagactccactctctctgtccgtcacccctggacagccggcctccatcctcctgcaagtctagtcagagcctcgtgcatagtgatggaaacgacctatatgtactggtacctgcagaagtcaggccagcctccacgactcctgatttatcgtaacgtttccaagtcgtttattttggagttcgccagacaggctcgagtggcgaggtcgggtacagggacacgtatttaccacacgtagaaaacgtcgacggccggggtagagggtctagggagagttggttaggacttaagttttaattattgacctagttagacttaaagtttccaggtcttgtttacttacgttttcgggccgtacggggtacctacgtaccgtggactactaaccg

SEQ ID NO: 105599 - DNA, 679 bp, Homo sapiens
  misc_feature: GYAE6OF02GGZCQ.29.71.G05.1.454.CMB.1.raw
  modified_base (212)..(212): a, c, t, g, unknown or other
  misc_feature (212)..(212): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctggaggctgtaggtgcttgtccttgctaatgcttcgtggataccgtggatccgagtggagtattagttgagatcgacccagacctccactctctctcgtccgtaccaccccgtggaccacggcccggcctccctaacttcctcccgtgacctaaacgttctacgttacaagaccgtcccgttcggtacgactaagttacggtagtaaggttaacgggaaaacgttaccgtaattaacgttacgttaacgttcggttaaccgttaggaccgtaaagggtaacgtcccggaacggtacccgaaccggtcccctaacccgaccgtacccgttacccgttagttacgttttaacgtaggttaaaccgtttcgtaaacgtttcgttttagtttggacggtttccgaccgtaagaccggtaggtaccgtacgtacgggtcggacgacggggtcccggtaggtaacgggg

SEQ ID NO: 105600 - DNA, 821 bp, Homo sapiens
  misc_feature: GYAE6OF02G7YTA.29.71.G05.1.454.CMB.1.raw
  modified_base (160)..(160): a, c, t, g, unknown or other
  misc_feature (160)..(160): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
tcagatagagtactcacgaccggtgctcgatttagtgtcgtcgcaagagagaggggactgatcaggactctcagttcatcttctcaccatgagcctccctgctcagtcctccgtgggctcgactaatgctcgtaggactaccgtggatccgaggtagganatattgaagatcgaacccagtacctaccactcctctcgtcgtcctcccaccctgacncggcccgtcctaccnctcncccgtgactaacgtctagtccgaacggctcccgtcggtacgcgtaacgtaggtagtacggtaacgggtaaaacgtaaccttaagtaattacgggttaaccttcccggggtaacctcgtaaccgtaaaaggtacggtaccaacgggccctaaccgggtcccccaaccgtaaccgaaccttcccgtaagttacttttaacgtaacggttaacgtttaacccgagtttaacgtttttacgtaaggttacgtcggaacctaaacgcgtaacgtcctagtaggccggtacacggggtagtaccggaacgggtacgtaagtttaacgtacgttaaccgaaacgtaagtaaacggttcgaaacgggtccggggttaaacggacggttccggggtaaagtaacgggttagttaacgggtacgttaacgtttaagttttaagtttaaccgggttgtaaactaacgttacgtaaacggttttaacgtaacggttacgttcgttacgtttaaccgtttaccggttacggttaacccgggacccggtttaaacccaccggtttaaccgggtaccgttaacggaaccgtaaaacccgg

SEQ ID NO: 105601 - DNA, 853 bp, Homo sapiens
  misc_feature: GYAE6OF02IDBOJ.29.71.G05.1.454.CMB.1.raw
tcagatagagtactcacgaccggtgctcgatttagtgtcgtcgcaagagagaggggtgagtcgaggacttctcagttcatcttctcaccatgaggctccctgctcagctcctgggctgctaatgctctggatacctggatccagtggagatattgagatgaccctagacctccactctctcttcgtccgtccacccccgtggacctacggcccggtccctacctacttccgtaccctggaccaaacgttccgtacgtccgacggacgtccgttcgtcgcctaagtacgtggaatacgggtaaaacgtaccttaagttaagttcgtaaccggttcggtaccctgtaccgaaaggtaacgttcgaccggaccacgtccccttaccgaacggtcccttaccgtgttaactttagtacggtaacgttttaccgaacggttacgttttagtttacgggagtttaaccggaccgttagaaaccgttacgggtaccttacggaagggtttccgggaccgtaacgggccggggttaacggtaaccggggtaacgtaaacgggttaccgttttaaaccgaaccggttaaacgtaacggttaaaaacgtacccggtacggggtaccgggtaagggtaccgggtacgttaaacgggaacgggttaggttcgggttaacggttccttaaaggtttttacgttaaccgggtttgtaccggtaattaaccgggtaaacgtttaaacggttacgttacggttaccgtttacggtttacccgttaacggttttccggaaaccgggtaccggtttaaccgaccggtttacccggtaacggtaaccttaccggtaaacccgttaaaaccgg

SEQ ID NO: 105602 - DNA, 694 bp, Homo sapiens
  misc_feature: GYAE6OF02IA4OS.29.71.G05.1.454.CMB.1.raw
  modified_base (566)..(566): a, c, t, g, unknown or other
  misc_feature (566)..(566): n is a, c, g, or t
tcagatagagtactcacgaccggtgctcgatttagtgtcgtcgcaagagagaggggtgatcaggacttctcagttcatcttctcaccatgagctccctgctcagctccgtgggctgctaatgctcgtggactacctggatccgaggtggagtattagttaggagactcgaccctagacctccactcctctctcgtcccgtcacccgtcggaccacggccccgacctcccattccctccgtacgacctaacgttccgtacgtacgaacggtactccgtcgtacgactagtaacgtgtaagtaacggaaacgtaccttaagtagttacgtacgttaccgtaccgtacggtacgaacgaacgtccgaccggaccgtacgtcccccgtcgaaccgtcccttaccgttattacttagtacgttaacgttacctaagttcgtttagtttcgacggtacgacctaagtacggtcgtacgtcgtagggcggtacgtacgggcggtaccggaacggtctaaggttcttaaccagtaacgtaagtaaacgtacggtaggggaccggttggaaccgngtaggaacggtgttgggttagtactttaggtaattgtactagtacgttagtaacgttagtacctagtacgtttcgtacgtttcgtaccggtgtacggtactcgtaaccgtggaacctactaaggaccg

SEQ ID NO: 105603 - DNA, 888 bp, Homo sapiens
  misc_feature: GYAE6OF02HEAGP.29.71.G05.1.454.CMB.1.raw
tcagatagagtactcacgaccggtgctcgatttagtgtcgtcgcaagagagagggggtgagtcaggacttctcagttcatcttctcaccatgaggctccctgctcagctccgtggggctgctaatgctctggactaccgtggactccaggtggagatagttgagatcgacccagtactccactctctctcgtacctccacccgtgacacgccgcctccgatcctcctgacaacgttcgttacgcacggactccgtcgtacgactaagtaggtagtagtagggaaaacctacttaagtaacgttacggtaacgttcggtacccgtagtaccggaaagtaacggtaccgtacggaccgtacggtacccccgttaccgaaccggtaccttaccgtacggtttaaactttacggttaaacggttaaacccgttttacccgaaaaggtttccggttttaaacggttttgggaaccggtttacggaccggtaaacgtaaccggtaacgggtactaaccggtacgtttacgggcgttacgggtaccggggtacggaaggggaaccttaacgggttaacgttacctaaacgtaccggttaaaaacggtaaaccgtaacgggttaacccggggaccggggttacgggaaccgggttacgttaaccgggggaaagtttagggtaaccgggtttacgtacgggtttaaagttttaacggttttaacgtcgttaacggttaactttaacgggggtaaacttttaaaccggttaacgacggttttaccgttaaccgggttttccgttaaaccgggttttcccggacccggggttaaacgggttaccctaaccggttttaccggaaccggttaacgttaccggttaaccgttaaaaaccggg

SEQ ID NO: 105604 - DNA, 750 bp, Homo sapiens
  misc_feature: GYAE6OF02J3H3S.29.71.G05.1.454.CMB.1.raw
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcacggccctgagtgggtgacttcgcaggcgtagtactttgttcgttctcgtagtctgtctttgctcngtcgtcgngggtcnctgcgtgacggtcgttggtaggtctcgttacgttccttggtactagtcgtcgttacgtacggtacctaccggtcggtacctacgggtaggttaaggtaacgttagttacggtacggtaacctaccgtacccgaacccgtactacccgttacctcgttccgttccttaccggtcccgtacccgtacccgcccggtacggacccggtccgcccgttacctacctccgtccgtacgtaacgtacgtacgttacgtacgtcgtacggtcctacgtcgtacgtacgtagtaggaagtaccgggtaaactaaccgtacttacgttacggttaccgttaccggtacgacgagtaaacgtacgacgtaccgctaaccgtcctaccgtacgtaccgttactacgtaaagttacgtttaacgtaccgttaaacggcgtttaacgttttgtaccggtgtaaccgtccggtacgtaacgtcgggttacctcgggttaacgacgggttacccggtacggggtaccgtacggaaccgttaccgg

SEQ ID NO: 105605 - DNA, 728 bp, Homo sapiens
  misc_feature: GYAE6OF02JTXA9.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctggaggctgtaggtgctcgttccttgactaatggctcgtacggactaccgtgggtactccgtaggttaggagtattagttagagtatcggaacccagacctaccacctctccttcgtcgtcccgtccaccccgttaggaccacggcccggtccctcctactccttcccacggtacgtaaacggtcgttaacggtcaacggaccgtcccgtacggtcgacctaaggtacggtaggtaacgtaaacgggaaacccgtaccgttaattaacggtacggttacgttaccgggtaaccgtacgtaacgtaacggtaaacgttcccgaaacggtcccgaaccgtaccccgtaccccgtaacggttacccttaccggtacgtttaacgttttaacgtaaccggttaaagtttacccgaagttttaccgtttaggtttcggacgtttaccgaccggtacgtaaccgacgggttacccttagacgggtacgtaccggtagggtaccgggttacggaacggg

SEQ ID NO: 105606 - DNA, 592 bp, Homo sapiens
  misc_feature: GYAE6OF02JGCHT.29.71.G05.1.454.CMB.1.raw
  modified_base (228)..(228): a, c, t, g, unknown or other
  misc_feature (228)..(228): n is a, c, g, or t
  modified_base (396)..(396): a, c, t, g, unknown or other
  misc_feature (396)..(396): n is a, c, g, or t
tcagatagagtactcacgaccggtgctcgatttagtgtcgtcgcaagagagagggggtcaggctggaactgaggagcaggtgggggcacttctccctctaacactctccctgttgaagctctttgtgacgggcagctcaggccctgatgggtgacttcgcaggcgtagactttgtgtttctcgtagtctgtctttgctcagcgtcagggtgctgctgaggctgtaggngctgtcctgctaatcgctcgtggataccgtggatccgagtggagattagtgagatcgaccagacctccaacctctcttcgtcgtacccgtctaccccgtggaccacggtcccggcctaccgtatcctctcgacgatccgtagtcgagactccgtgtcgactagtagtnaagtagaaacgtactaattaagtcgtacgtacggtactacgacgtacggtaagtccacggtaccacggtccctaccgaaccgtaacctccgtagtaactttagtaacgttaacttacgtaacgttaccgttttagttcggcgtcgtactacgaacgtcggcttacggacggttagcgtagggtccggacggtacgg

SEQ ID NO: 105607 - DNA, 787 bp, Homo sapiens
  misc_feature: GYAE6OF02FPTAD.29.71.G05.1.454.CMB.1.raw
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccaggtggagatattgagatcgacccagactccactctctctgtccgtcaccccgtggacacgcccggcctccatcctccngacaagtctagtcagacgtcctcgtgactagtaggtgagtaggaaacgtactatagtgtcgtcggttaccnggtacaaggacgtcgacggccgacgtcccgtaccaaccgtccttccgtaggtttaacttttacgaggtttaaccgtttaccgaacggtttacggttttaacgttttagggaacggttccgaacccggaagtaaccggtacgggtaccttacggtaagggtccgggtaccggtacggggtacccggggtacgggaacggggtaccgtaaggttacctttaccggtaactaacggttaaacgaaacgttccggtaacggggtcggggtaacgggtacgggtaccgtagggtaacgggttaggttagggttcggttaacgttttaagtttttacggttaacgttacggtacgttacggttaacgttaacgtttaaacggtttacgtacggttaccggtttttacgttaccggttttacggtttaccggggaacccggggttaacggtaccgttaccggtaccggttacggaaccgttaaccgttaaccggtaaaccgg

SEQ ID NO: 105608 - DNA, 652 bp, Homo sapiens
  misc_feature: GYAE6OF02GLDZD.29.71.G05.1.454.CMB.1.raw
  modified_base (212)..(212): a, c, t, g, unknown or other
  misc_feature (212)..(212): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtnctgctgaggctgtaggtgcttgtccttgacttaagtcgctcgtggactaccgtggactccgaggtcggagtatagttggagtatcgaacccagacctccacttcctctctcgtccgtccaccccgtggaccacggcccggtccctccgtacttccgtccctgaccgtaacgttacgtacgtacgaacggacgtccgttcgtgacgtaacgttaggtagtaagttaacgggaaacgtaaccttaattagtacgttacggtacggtaccgtgacaaggtaacgtcgacggccacgtaccctaccgaccgtaccttcgttagttactttagtaagttaaccgtttacgaagtttaccgttttagtttacggagttcggaccgtaacggtacgtacggtacctaggtacgggtcggaccggtagggtaccggtaggtaaccggg

SEQ ID NO: 105609 - DNA, 655 bp, Homo sapiens
  misc_feature: GYAE6OF02IXJSR.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctgggctgctaatgctctggatacctggatccagtggagatattgagatgacccagactccactctctctgtccgtcacccgtggacagccgcctccatcctctgcaagtctagtcagacgccgtcgtgcataggtgagtaggaaacgacctatattcgtactacggtacctgacaaggacgtcgacgccgacgccctaccgaacgtaccttccgtagtactttacgagttaacgtttaccgaaggttcgttttaagtttggacgttcgaccgtacgtacgtacggtctacgaggtcggcgacgggcgggtacgagggtactaggttacttacaacgtacgtaagaaacgtcggacgggtaccgggtaggacggtacgtaggtaacggtgttacggttcgggtacttttaagttttactttagttacgtacgtacgttagtaacgtttaaacgttacgacggtttcgtttacggtttaccgttaacggtttcgggaccggtacggtactaccggttaccggtacgtaactacgtaacggtaaacgg

SEQ ID NO: 105610 - DNA, 749 bp, Homo sapiens
  misc_feature: GYAE6OF02GMJD9.29.71.G05.1.454.CMB.1.raw
  modified_base (248)..(248): a, c, t, g, unknown or other
  misc_feature (248)..(248): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatcgacccagacctccactctctctgtccgtcaccccgtggacacggcccggcctccactcctccctgcaagtctagtcagacgcctgtcncatgtgataggaaagcctatatcgtactggtacctgacagaagtcgaggacctacgccctaccgaccgtacctccgtagtacttttaacgtaggttaacgtttacccgaaggttactttttaaggttttcggggaacgttccggaacccgaagggtaacccgtaacgggccttaccggtagggtttcgggaccgagggtccggggtacggtaaaggggaacgtaacgggttactttaccaaccgtaacgtaacgtaaaaacgtcggaaccgggttaccgggggacgggtaacgggtcgtaagggacgggtaaggtttggttacgggtacttttaaagtttttaagtttaacgttcggtaacctaacggttaacgggaactttaaacggtttacgacgtttacggtttacgtttaccgtttaccggtttaaccggcccggtaacggggtacccttaaccggttacccggtaacgtacccgtaacgttaaccggtaaaaccgg

SEQ ID NO: 105611 - DNA, 780 bp, Homo sapiens
  misc_feature: GYAE6OF02JYX35.29.71.G05.1.454.CMB.1.raw
  modified_base (159)..(159): a, c, t, g, unknown or other
  misc_feature (159)..(159): n is a, c, g, or t
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
  modified_base (263)..(263): a, c, t, g, unknown or other
  misc_feature (263)..(263): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctcgtggatacctggatccagtggagatattgagntgacccagtacctaccactctctcgtacgtccgtccaccccgtggacncggcccggtcctccatcctcctnaccgtagtccgtaagtccgagacgtccttcggngtaccagtagtgaatagggaaaacacttagtatagtacgtaggttacctgacagtaacgtcgaggtcccaggtccctaccgaccgtaaccgtaccgttggtaatttacgtaacgttaaccgtttacccaaaggtttccgggtttttaagttttacggggaagttacccggtacgaaacggggtaacccttacggggtacgtttacccgtaaggggtccgggtaaccgggaacgggggtttacccgggtaccggggaaaacggggtcgtaaacggtttcgtaaaccggtaacctaacgggtttaaaaccgaaaaccggttcgaaaccgggggtcccggggttaaacggggaacgggttcgtaagggtaacgggttagtttgggtaccgggttaactttagtttacgttagtaccgtacagtaacggtctttaaaagtcgaagttcgtaacgtttcctaggttacgggaccgttaaggtcgtttaccacgtttacgggaacttccgtaaccggtaacgg

SEQ ID NO: 105612 - DNA, 650 bp, Homo sapiens
  misc_feature: GYAE6OF02IOUGA.29.71.G05.1.454.CMB.1.raw
  modified_base (215)..(215): a, c, t, g, unknown or other
  misc_feature (215)..(215): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgtctttgctcagcgtcgagggtnctgctgaggtctggtaggtgctgttccttgactatgtctcgtaggataccgtggactccgaggtaggagtatagttagaatatcgaacccacgtactaccacttcctctactcgtccctaccacccgtagacacgcccgactcctatcctcgtagactaacgtctagcaacgactcccgtgtcgactagtagtagaacggtaacgaaacttacttaataacgtacgtacgttacggtaccgtgtaaccgaaggttaacccgacgtacgacccgtccgtacccgtacctaaaccggttcctaccttaaggttaactttaagtaccggttaaaccgttttacgaagttttcggttttagttaggcgtaacgtaacccgtagaaccggtacgttagccgttaacgggttgccggtaacggtaccggggtagaaacggg

SEQ ID NO: 105613 - DNA, 655 bp, Homo sapiens
  misc_feature: GYAE6OF02HJHLA.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtccgtcacccctggacacgcccggcctccatcctcctgaccaagtctagtcagacgcctcgtgcatagtgataggaaagacctaatatgttactcggtacctgacaagaagtcacggccacgccctcaaccgaccttccctagtattttagtagttaacgtttacccgaaagttcgttttaagtttttgggaacgttacggaccgaaggaacgagggtaccgtcgtagggtggacgacgggtcgggtacgaagggactaagtacgtttacaaccaacgttaagaaaactcggacgggtccggggtaggaggtcgtagggaggtacgttgggttacggtatttagttttaattgttacgtcgtaacgttagtaacgttaacgtttacgtaggttctttacgttacttaccggttttacgggaacccggttacgggaccttacggttacccggtagtaaccgtataaaacccgg

SEQ ID NO: 105614 - DNA, 732 bp, Homo sapiens
  misc_feature: GYAE6OF02IMZWD.29.71.G05.1.454.CMB.1.raw
  modified_base (241)..(241): a, c, t, g, unknown or other
  misc_feature (241)..(241): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccagtggagatattgagatcgacccagacctccactctctctgtccgtccacccgtggacacgcccgcctccactcctcctgactaagtctagtcagacncctcgtgactagttaggtagaagtaggaaaacgtccttaaagttattcggttaaccgttcgggtaccctggaactaagggtaaaccggtcgaacggcccaacggtcccctaccgtaaccgtaccttacccgttagttaacgttttaacgtaaggttaaccgttttaacccggaaagttttccgggtttttaagttttcgggaacgttcgaccgtaggtaaccgtaacggcctaggagggttcggacggacgggtcgggtacggaacgggtaacgtagtacgtttacaactaacgtaaagtaaacgtcggtaacgggtaccgggtagggaacgggtcgtagggaggttacggttggttaggtactttaagtttaagttacgttgtacgtaagtacgtaagttaagttacgtacgttcgttacgtttaccgttacggtttacgggaccggtacgggtacctaacggttccgtaggaacctacgtaactaacgg

SEQ ID NO: 105615 - DNA, 695 bp, Homo sapiens
  misc_feature: GYAE6OF02G5O2K.29.71.G05.1.454.CMB.1.raw
  modified_base (241)..(241): a, c, t, g, unknown or other
  misc_feature (241)..(241): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatcgaccagactccactctctctcgtccgtccaccctggcacgccgcctccatctcctgacagtctagtcagacgccttgtnctatagtgagtacggaaacgacctaatagtgttacgtcggttacctgaacaagtaagtccgaaggccacggtaccctacccacgtaccttccgttagtactttatacggtaacgtttaccaaggtttccgtttagttttagggacttacgtaccgaaacgtacgacggtacctacgaggtacgggacgtacgggcggtaacggaacgggacctagttacgtttacaacgtaacgtaagaaaacgtccgtaacgggccgggttagggacggtagtacgggtaaggtcgttaggttcggtaaactttaaggttttacgttacgttcggtaccttaaaggttacgttaaccgtttaaacgtttaccggagtttacccgttcggttttaaccttacggttttaccggccggtaaaccggtcccgttacgtaccggtacgtaacctacgttaaaaccgg

SEQ ID NO: 105616 - DNA, 570 bp, Homo sapiens
  misc_feature: GYAE6OF02HRO0U.29.71.G05.1.454.CMB.1.raw
  modified_base (216)..(216): a, c, t, g, unknown or other
  misc_feature (216)..(216): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacagccggcctccatctcctnacagtctatcagagcctcgtgcaatagtgaataggaaactacctatactagtactcggtactagacaggaagtcgagccagccctcacgtactctatatttanagtaacgttcaagtttcttagtttggaagtcgaccagacacggctacgaggtccgagaggtcggtacgacgganacgtattcaacgtactagaaatcgagggtccggtaggaggtcgaggagtgttaggttacgtataatttagttagttgtactagtgtaacgttaagttacgtatccgttaggttacctttacggttcggtaccggtaaggtacccgtagttcccgttaggacttacgtacgtaaacgg

SEQ ID NO: 105617 - DNA, 765 bp, Homo sapiens
  misc_feature: GYAE6OF02IRXW7.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagcctccgtggggctgctaatgctctggataccgtgatccagtggagatattgagatcgaccagacctccactctctctcgtcccgtccaccccgtggacacggcccgcctccactcctcctcgacaacgttcgtacgtcgaggacgtcccgttcggtacgacctaagttaacggtggtaaacgttaaggggaaaaccgtaacccgttaattaacgttacggttaccgttaccgggttacccttaggacgtaaggaaacggttcgaaccggtccaccgcccctacccgaaccgtaccttaccgtagttacttttaagtacggttaaaccgtttaaccgtaaagttacgtttttaaggttttacggacggttccgaccgtaagaaccggaggtcctacgtagggtacgaccgtaggggtacgggtacgaagggactagtttacgttaccaactaacgtaagtaaacgtcgaacgggtccgggtaaggacggtcgtagagttagttggttactacgtttatttattacgtgacgttaacgttacgtaagtttaacgttacgttacggtaacctttccggtttacgttaaccggtttcggaaacccgggttaacgtacccgttaggttaaccccggtaggttaacccgtacgttaaacccgg

SEQ ID NO: 105618 - DNA, 689 bp, Homo sapiens
  misc_feature: GYAE6OF02IH0CC.29.71.G05.1.454.CMB.1.raw
  modified_base (336)..(336): a, c, t, g, unknown or other
  misc_feature (336)..(336): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcgagggtgctgctggaggctgtaggtgctgtccttgctatgctcgtggataccgtggactccgagtggagtattagttagagtatcgaacccagtacctccactcctctctcgtccgtccacccgtgaccncggcccgtcctcactcctcctagactaagtctagtcgagacgtcctcgtcgactagtagtgtaagtaacggaaaactaccgttaattaacgttacggttaaccgttacggttacccgtacggaacgtaaaggtaacgttaccgaaccggaccgaccgtacccctaccgaaccgttaccctccgttaagttaatttaacgttacggttaaaccgtttaccgtaaacgttttcggttttaaggttttcggaacggttccgtaacccgtaacgggtaaccgtaccgggttaccgttacgggtaacgggtttacggggacccggtacgggggtccccggggtaacggtaaaccgggg

SEQ ID NO: 105619 - DNA, 762 bp, Homo sapiens
  misc_feature: GYAE6OF02FH8FI.29.71.G05.1.454.CMB.1.raw
  modified_base (190)..(190): a, c, t, g, unknown or other
  misc_feature (190)..(190): n is a, c, g, or t
tcagatagagtactcacgaccggtgctcgatttagtgtcgtcgcaagagagagggggtcaggctggaactgaggagcaggtgggggtcacttctccctctaacactctcccctgttgaacgctctttgtgaccgggcgagtctcgacggccctgatgggtgacttcgcaggtcgtagactttgtgttacncgtacgtcctcccgtgcctacgcgtcctccgtggggcctacgacctaactcgtacctcgtacggtaaccttacccggtgactccgtaggtacgggtactacgttagtacggactaccgtaccgtaccgtaccgtaccctcccgttaccgtccgttacccgtaccgttcccggtaccccgtacccctacccggttacggaccgtaccgtccgttacctaccgtacttcctaccgtactacgtaaccgtaccgtaccgtaccgacgtaccgtaccgtacgtacgtacgtacggtacggtacgtaacgtaaccgtactaccttacgtacggttaccgtaccggtactacgtacgtacgtacgacgccgaccgtaccgtaccgtaccaccgttactcctacgtacgttactacggttacgttaaccgtacgtttaggtttacgttacgtacgacgtaaccgtacgtacggtacgtcgtacgcggtacggaccggacggtaccggtacgtacggtaaccgtacttaccgttaacgaccgaagtacggaaccgtccgcgggacggttcggtagtacgg

SEQ ID NO: 105620 - DNA, 610 bp, Homo sapiens
  misc_feature: GYAE6OF02HHPVP.29.71.G05.1.454.CMB.1.raw
tcagatagagtactcacgaccggtgctcgatttagtgtcgtcgcaagagagaggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaagtcggctctggattaccgtgggatccagtggagattagttgagatggacccagacctccactctctctcgtccgtcacccgttggactacgccggtcctcccgatcctctgactaacgtctagtcagacgtcctcggtgcctagtacgtagagtaggaaacgaccttatacgtggtaacttcggtacctgactaggaacgtcgacggtacccacggtccctaccggactaccgtcttacgtattttagacggttaactttacccgaagttacgttttagtttacgggtacgtaccgcccggtaagaaccggttacggtccttacggtacggttcggacccggtaagggtccgggtacgtaaaccgggg

SEQ ID NO: 105621 - DNA, 605 bp, Homo sapiens
  misc_feature: GYAE6OF02F5WC5.29.71.G05.1.454.CMB.1.raw
  modified_base (359)..(359): a, c, t, g, unknown or other
  misc_feature (359)..(359): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgctcagcgtcgagggtcgctgctggaggcttggtaggtgctgttccttgctaatcgctcgtaggactaccgtggactccgtaggtggagtattagttggaagatcgaacccagtacctccactctctctcgtccgtccacccgtggacaccgccgtcctacnctcctctagactaagtctagtcagctccgtcgtcgactagtacgtagacgtaacggtaaacgtacttagttacgtacgtacgtacgtaccgtagacgaagtacgtaccgacggtcccgacgtccctaccgaaccgtcttaccgttagttacgtttaagtaacgttaacgttacgtaagtttcgtttagttaggacgtcgacctagtaaccgtgtactgacggtcgacgcgggtacggtagtaacgg

SEQ ID NO: 105622 - DNA, 708 bp, Homo sapiens
  misc_feature: GYAE6OF02GZ6T7.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatcgacccagacctccactctctctcgtccgtccacccgtggacagccggcctccactctcctgacaagtctagtcagacgtcctcgtcgcattaggtgagtacggaaacgaccttagtactagtacgtcggtacctgacgaagaacgtcgacggccacgtccctacccgaccgtaccttaccgtagttacttttaacgtacgttaaacgtttaccgaacggttccgtttttaagttttcgggagttacggacctaacggacgtacgggtcccgttacggagggtccggacgtacgggtccggggtacgaacggggtactaaggttaacgttaccaaacgtaccttaaaggaaacgtcccggaacggggtacccggggtagggtacggtcgtacgggaggttacggttaggttacgggtaatttagtttttagttaacgttgacctaagttactaacggtttaacgtttacgtacggttctttacggttaccttaggttttaccggacggttacgggtacctacgtaccgtaggtacctacgtaaccg

SEQ ID NO: 105623 - DNA, 739 bp, Homo sapiens
  misc_feature: GYAE6OF02JP9LA.29.71.G05.1.454.CMB.1.raw
tcagatagagtactcacgaccggtgctcgatttagtgtcgtcgcaagagagaggggtcaggcgtggaactgaggagcaggtggggcgacttctccctctaacactcctccctgttgagctctttgtgacggcgagctcaggccctgagtggtgacttcgcaggcgtagtactttgttgtttcttcgtagtcgtgtcttgtctcgagcgtcgaggtgcgtgcgtgacggtcgtggtacggtgtctgttccgttgctaagtcgtctcgttaggtacgttaccgtggtactaccgtaggttaggaagtattaagttagaagtacttcgaaccgaacgtccgtaccctaccgtccttacgttcccgttcggttccccgtccctacccgttacggaccgtaccggaccccgtccctctccgttcctccgtacacgtacgtacgtacgtacacgtaccgtcgtaccgtcgacgttagtagtacgtaacgagtaaacgtaccgttaaagttacgtacgttccgtacgttaccgcgtacgtaagaacgtccgaacgaccgtaccgtacccgtaacccggaaccgttacccgtaccgtttagttaacgttttacgtaacgtttaaaccgttaacgttacgttaaccgttttaggttacgttacggtccggttaaccgacggtaaccggtccggtaccgtacggttacggttcgggaccggtttaaccgggcgggttaaacggaccggg

SEQ ID NO: 105624 - DNA, 715 bp, Homo sapiens
  misc_feature: GYAE6OF02FPB70.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtccaccctgacagcccggcctccatcctcctgcaagtctagtcagacgcctcgtgctatagtgataggaaacgtacctatatgtactggtacctgacagaagtcacggtccacgtcctaccacgacctccgtgtaatttagtagtaacgtttaccgaagttcgtttaacttttgggagttacgacctaacgtacgtaggtctaccgtaggtacggacgtagggtcgggtaccgaaggggtaccaacgggttactttaccgaaccgtaaacgtaacggaaaaacttccggtaacgggtcccgggggttaagggacgggtcggttaacgggtagggtaacgttagggtttaccgggatttaacgtttttaacgtttaagtttcggaacttaacggttacgtaaccgtttaaaagttttaccggaacgttaccgtttaacgttacgtttaaccgttttaccgggaccgttaacgggggtacccttaacggttaccggttacggtaacccgtaacgttaacccggtaaaaccgg

SEQ ID NO: 105625 - DNA, 714 bp, Homo sapiens
  misc_feature: GYAE6OF02JEZMM.29.71.G05.1.454.CMB.1.raw
tcagatagagtactcacgaccggtgctcgatttagtgtcgtcgcaagagagagggggtgatcaggacttctcagttcatcttctcacatgaggctccctgctcagctcctgggctgctaatgctctggatacctggatccagtggagtatattgagatcgaccagactccactctctctcgtccgctaccctggaccacggccggcctcctacttcctccgtcgacgtaaactccgttaggtacgaggtacgtccgtcgtgacctagtagtacgtagtaacggtaaacgtaccctagtaacgttagttaccgttacggttaccctgaccgtagaacgtacgtacggaccaggtccccacgaacgttccgtacttaggtacgttttaagcgttaaacggtttcaaacggtttgtttacggtttacggaagtcgtactacgacgtaacgtgtacctggtaacggcgacggcggtacgacggacgtaggtacttacgaacgtaagtaacgtaaacgtcggtaacgggtcgggtaacggtacgtacgtggtaaggttacggttacggttagggtacctttaagttacgtttacgtcgttaagtgttacgtaacgttaacgttcgtaacggtttcggttaacgtttccgtttaggtacggtaacccgggtacgttaaaccgtcgtttaccgggtagtaacgttaccggtaataaaccgg

SEQ ID NO: 105626 - DNA, 748 bp, Homo sapiens
  misc_feature: GYAE6OF02G83PA.29.71.G05.1.454.CMB.1.raw
tcagatagagtactcacgaccggtgctcgatttagtgtcgtcgcaagagagaggggtgagtcaggacttctcagttcatcttcgtcaccatgagctccctgctcagctcctgggctgctaatgctcgtggataccgtggatccagtggagactattgagactgacccagactcccactctctctcgtccgtccacccctggacacggccggccctcctactcctcctcgacgaacgtctagtcagacgtcctcgtgctatagtgtacgtaggaaactacctatacgtagtacctaccggtacctgacgaagtaacgtcgacggacctacgcccgtaccgaccgtacccttccgtagttaactttacgtacgttaaccgtttaccgtaacgttcgttttagtttacggacgttcgaccgtaaggtaccgacggtaccctacgtacgggtcggtaccgacgggtccgggtacggtacgggacgtaacggttaccttaccggtaaccgtaacgtaacggtaaaacgttccggtacgggtaccggggtaggtacgggtcgtaaggtaacggttagtttacgggttacggtaacgtttagttttaacttacgttacgtacgttacggttacgtaaccgtttaaacgttcgtaacggttccgtttaacggtttaccgtttaccggtttaccggacccggtaacgggtaccctacggttaccccgtacggtacctaaccgttaccgtaaacccgg

SEQ ID NO: 105627 - DNA, 906 bp, Homo sapiens
  misc_feature: GYAE6OF02HUDQQ.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctgggctgctaatgctctggatacctggatccagtggagatattgagatgacccagactccactctctctgtcctcacccctgacagccgcctccactctcctgacaagtctagtcagacgcctcggtgactattaggtgaagtaggaaaacgtccttaagttataggttaccgttacgggtacccttgacgaaggtaaacgtccgaacggccaccggtcccttcccgaaaccgtaccgttacccgtagtttaacttttacgtacggttaaacgttttcccgaaaggtttccggtttttaagttttaggggtacgttaccggtaacccggtaaaggaaccgtaacgggttcccgttacccggtaaggggttacggggtaccggtaacggggtcccggggttaaccggggtaaacggggtaaccggttaaacggtttaccgttttaaccgaaaacccgtaaccggttaaaaacgtaaaaaccgttacccgggaacgggggttaaccccgggggttaacgggggtaacgggtaaccgggtagggaaacggggttaacggtttcggggtttaacgggttacctttaaaggtttttaacgtttaacggttttaacggaaccgttaaacggttacggtaaaccgtttaaaaggtttaaccgtacggttaccgttttaacggttttacccggttttaaccggtttttaccggggaaccccggttaaccgggggttaacccttaccggttaacccgggtttaacccggtaaaccgttaaccggtaacccggttaaaaacccggg

SEQ ID NO: 105628 - DNA, 666 bp, Homo sapiens
  misc_feature: GYAE6OF02G1UT1.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtccacccctggacacggcccggcctccactcctcctgacaagtctagtcagacgccctcgtgacagtagtgaataggaaacgacctatatgtacgttggtacctgacaagaagtcgacggccacgtccctaccacgtaccttcctaggtaatttagtacgttaacgtttccaaggttcgtttagtttgggagttcgacctagtacgacggtctacgtagtcggcgagggtcgggtacgaggggactaggttacttacgaactaacgtaagtaaaacgtcggaacgggtccgggtaggaacggtcggtacgggaaggtgtttagggttcggtaactttagttttaacgtttacgttacgacttaacgttacgtaacgtttaaacgttactacggttacgtttcgttaccgtttacggtttcgggaccggttaacgggtacccttccggttccgaacggtaactacgttaaccgtaaaccgg

SEQ ID NO: 105629 - DNA, 717 bp, Homo sapiens
  misc_feature: GYAE6OF02GX3BM.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccaggtggagatattgagatgacccagactccactctctctcgtccgtccaccccgtggacacgcccggcctccactctcctgacagtctagtcagacgtccgtgtcgactagttaggtgaagtaggaaacgtaccttaattagtaggttacgttacggtaccgtggacctaaggaacgtccggaccggaccacgtaccccgtaccgaaccgtacccttaccgttagttaattttaacggtacgtttaaaccgtttaccgtaaggtttacggtttttaagtttttacgggtacggtccggtaccgaaggtaccgtagggttcctacggtacgggttcggaccggtacggggtccgggtacggagggtaacttaggttacttaccaaacgtagtaagaaacgttcggaacgggtcgggtaggcgtcgtaggacgggttattcggtagtactttaagtttagtttagtgtacgtaagttacttaacggttaacgtttcgaacgtttccttacggtttaccgttcgggttacggccggtaaccggtctccgttaccggtacgtacctacgtaaaccg

SEQ ID NO: 105630 - DNA, 733 bp, Homo sapiens
  misc_feature: GYAE6OF02HQ8SR.29.71.G05.1.454.CMB.1.raw
  modified_base (157)..(157): a, c, t, g, unknown or other
  misc_feature (157)..(157): n is a, c, g, or t
  modified_base (348)..(348): a, c, t, g, unknown or other
  misc_feature (348)..(348): n is a, c, g, or t
  modified_base (459)..(459): a, c, t, g, unknown or other
  misc_feature (459)..(459): n is a, c, g, or t
tcagatagagtactcacgaccggtgctcgatttagtgtcgtcgcaagagagagggggtgatcaggacttctcagttcatcttctcaccatgaggctccctgctcagcctctgggctgctaatgctctggatacctggatccagtggagattattgangtacgaccagactccactctctctcgtccgtaccaccccgtggacacgcccgcctccatcctcctagactaagtcttacgcaggacgccctgtcgactatgtagatagggaaactcctaaagtctacgtacgtacggtaccctgaacgtaggtaatccgacggcccacgccttacccaacgtctaccggtntaagtttcaaggttaaccgttacgtaaggtttcgtttaacgtttggaacggttcgaccgtacgcgtaacggtctagacggggtgaccgtgggacgggtaacgacggggtanacggtttactaccgtaacgtagaaaacgtaacgtcggaacggggttccgggaggggttacccgtagggtaggtaaagggtttggtacggggtttactccggttttaaagttttttaggttaccccgttaagggttaaacttcgggttccggttaaaaaacgttttcgggtttactacgggtttcctttaacgtttcccgggttttaacgtcgggtaacccgggtacccgtaacgtccgttaggtacccggtaactgtaaaacccgggtaaaccc

SEQ ID NO: 105631 - DNA, 720 bp, Homo sapiens
  misc_feature: GYAE6OF02GLFEZ.29.71.G05.1.454.CMB.1.raw
  modified_base (250)..(250): a, c, t, g, unknown or other
  misc_feature (250)..(250): n is a, c, g, or t
  modified_base (655)..(655): a, c, t, g, unknown or other
  misc_feature (655)..(655): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatcgaccagactccactctctctcgtccgtccacccctggacacggcccggcctccactcctcctgactaacgtctagtcgagacgcctcgtncatagtgataggaaacgctatatacgtactcggtacctgacaagtaacgtcgacggtacccacgcccctaccgaaccgtaccttcccgttaagttaacttttacgtaacggttaaaccgttttaacccgaaggttttacggttttaagttttagggaacggttccggaacccgtaacggtaaccgaacgggttccttacggacgggttcgggaaccgtacggggtacccgggggtaagaaacggggtacgtaacggtttaacgtttacccaacgtaacgtaaaacgtaaaccgttcggtacgggggtaccggggtaggtacggggacttagggacgggttacgttggggttactactttaaagttttgttaagttcgattacggtaagtaacctttaaggttacngttacgttcgttacgttacggttacggacggtacggtacagttccgagtaactagtaccgtaacg

SEQ ID NO: 105632 - DNA, 609 bp, Homo sapiens
  misc_feature: GYAE6OF02F9U16.29.71.G05.1.454.CMB.1.raw
tcagatagagtactcacgaccggtgctcgatttagtgtcgtcgcaagagagagggggtcaggctggaactgaggagcaggtggggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctggtaggtgctgtccttgctaatgctctggatacctggatccagtggagattattgagatgacccagacctccactctctctcgtccgtccacccgtggacacggcccggcctccgactcctcctgactaacgtcttagtcgagacgcctcgtcgctatagtgatagggaaactactattatcgtacgtcggtacctggaccaaggtaacgtcgacggacccacggccctaccgacgtaccttacccgtagttacttttacgtaaggttaaccgtttaccaacgttacgtttttagtttacgggagttccgtaccgaacgggtaccgtacggtaccgttacggaacggtttccgggacgtacggggttcccgggtagtaaacgggg

SEQ ID NO: 105633 - DNA, 814 bp, Homo sapiens
  misc_feature: GYAE6OF02HDPPQ.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccgagtggagatattgagatcgacccagtacctccacttctctcgtcgtccgtccaccccgtggaccacggcccggcctccattcctccctgacctaagttcgtacgtcaaggtaccgtcccgttcggtacgctaagttaggtacgaaagttaggggaaaaacctacccttaagttaacgttggttaaccgttcgggtaacccctgaacgaagggtaaacgtccggacgggtccaacgtcccctaccgaacgtaccttacccgtagttaacttttacgacggttaaaccggtttaccaaacggtttacggtttttagtttaggggacgttacggacctaaggtaaccgttaggtcccgtacgtagggttcgggaaccggtacgggtcccgggggtaacggtaacgggtaactacgggttaactttaccgaaacgttaacgtaagaaaacgtccgggtacgggtcccgggggttaagggacggtacggtacggtaacggggttattacggggttacgtagttttaacgtttttaacgtttacgtcgtacgttaaattcgtaaacgttaaacggtttcaacggttccggttttaacgttacccgtttggtttaaccggaccggtaacggttaccttacggttaaccgtacggtaaccctaaggttaacctaaacgg

SEQ ID NO: 105634 - DNA, 731 bp, Homo sapiens
  misc_feature: GYAE6OF02JZBRX.29.71.G05.1.454.CMB.1.raw
  modified_base (666)..(666): a, c, t, g, unknown or other
  misc_feature (666)..(666): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctcgtggataccgtggatccgaggtggagatattgagatcgacccagacctccactctctctcgtaccgtccacccgtggacacggccggcctaccgatcctctgacctaaggtcctagtcgagacgccgtgtcacgtaagttcggtagtagtacgggaaaactaccttaagttacgtacggtaccgtacggtacccgtagacgaacggttaacgccggacggaccctacggcccctacgaaccgtaccttcgtaggtaatttacgtacggttaaacgttaccgaagtttacgttttagttacgggacttcggaacccaaggtaccgtaggtaccgttacggaaggtttcgggacccgtaggggcccgggttaacgaaccggggagtacgttagttaacccgaacgttaaacggtaaacgtaaaccggtcgggtaacggggccgggggttaaggacggtaacgtgggaaacgggtttgtttcgggtacgttacgtttattttaagtcgttaacgcggtagttaacgaatttaacgggtacngggttacttacgtttcggtagttaccgaccgaggtacctcggacgttgaacgtcaaccggtaacg

SEQ ID NO: 105635 - DNA, 590 bp, Homo sapiens
  misc_feature: GYAE6OF02HBLHP.29.71.G05.1.454.CMB.1.raw
  modified_base (344)..(344): a, c, t, g, unknown or other
  misc_feature (344)..(344): n is a, c, g, or t
  modified_base (391)..(391): a, c, t, g, unknown or other
  misc_feature (391)..(391): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatcgacccagacctccactctctctgtccgtcacccgtggacacgccgcctccatcctcctgcaagtctagtcagacgcctcgtgactataggagtaagtaaggaaacgtacctatagtgtacgtcggtaacctggacaaggaacgtccgacggccacgccctaccgacgtacctcctagtatttanagtaactttcaagttcgtttagtttggatcgacaagcgagtctacgngtcggcgaggtcggtacgagggtacaggtacttcgaacgtactaaagaaactcgtagggaccgggtaggacgtcgtaggaggtgttaggtacgtactttagtttattacgttcgatagtacgtacttaaagttcaaggttcttggttaccgttacgttcggacgtaggtacctgtaccgtaggtaactacggactaacg

SEQ ID NO: 105636 - DNA, 540 bp, Homo sapiens
  misc_feature: GYAE6OF02H37U9.29.71.G05.1.454.CMB.1.raw
  modified_base (98)..(98): a, c, t, g, unknown or other
  misc_feature (98)..(98): n is a, c, g, or t
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
  modified_base (472)..(472): a, c, t, g, unknown or other
  misc_feature (472)..(472): n is a, c, g, or t
  modified_base (496)..(496): a, c, t, g, unknown or other
  misc_feature (496)..(496): n is a, c, g, or t
  modified_base (511)..(511): a, c, t, g, unknown or other
  misc_feature (511)..(511): n is a, c, g, or t
tcagatagagtactcacgaccggtgctcgatttagtgtcgtcgcaagagagagggggtcaggctggaactgaggagcaggtgggggcacttctccctntaacactctcccctgttgaagctctttgtgacgggcgagctcaggccctgatgggtgacttcgcaggctagtactttgtgtttctcgtagtctgctttgctcagcgtcgagggtgcttgctgaggctggtaggtgctgtcctgctaatgtctctggtataccgtggactccgagtggagtatattgagntcgaccagacctcactctctctcgtccgtcacccgtgacacggcccgtcctcctactcctcctnctaagtctagtcagacgtcctcgtgactagtagtagtacgtaagggaaacaccttaatacgtagtactcggtacctgacgtaagaagtcacggtccacgcctacgacgtacctctatattnacgtaattcagtctttagttcggngtcacgatacgacgntacgtggtccgagtcggtcggtacgacgg

SEQ ID NO: 105637 - DNA, 675 bp, Homo sapiens
  misc_feature: GYAE6OF02F9UJI.29.71.G05.1.454.CMB.1.raw
  modified_base (269)..(269): a, c, t, g, unknown or other
  misc_feature (269)..(269): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtcaccccgtggacacgcccggcctccatcctcctgctaagtctagtcagacgcctcggtgacagtacgtgtaagtacggaaanacctattagtgttactacggtactcgacgaagaacgtcgacggaccgccgtcccgtacccaccgtccttacccgttagttaactttagtaaggttaaccgtttaccgtaaaggtttacgttttaacggtttggtacgtcgtacgaagtacgtacgtctacgtagggtccgacggacggtacgggtcgaagggacaacggttacttaccgactaacgtaaacgtaaactcgggaccgggtcggggttacggacgggtacgtagggtaggttagttcggttacggtacgtttaatttttaagttgtgtacttagtagtacttaacgttagcgtacgtttggttaccctttaggttaccggacccgggtacgtacgtccgttacggacctaagtaccgtaataaccggg

SEQ ID NO: 105638 - DNA, 792 bp, Homo sapiens
  misc_feature: GYAE6OF02FQ162.29.71.G05.1.454.CMB.1.raw
  modified_base (701)..(701): a, c, t, g, unknown or other
  misc_feature (701)..(701): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggatccaggtggagatattgagatcgacccagacctccactctctctcgtccgtccaccccgtggaccacgcccgcctccatcctcctgctaagtctagtcagacgtccgttcgtgactagttacggtgaacgttagggaaaacgtaccttaattagttcgttaacgttcggtaccctggacgaaggtaacgtccggacggccctaacggtcccctacccgaacgtaaccccttccgttaaggtttaacttttaacgtaacggtttaaacgttttacccgaagggttttccgtttttaaggttttgggacgttccgtaaccgtaacgggacgtacggtacgttacgacggggtcggaccgtcggggtccgggtaacggaacgggtaacgtaacgtttaccgtttaaccgaacgttaacgtaaacggtaaaaccgtccggtaaccggggtccgggggttacgggaccggttaccggttagggtaacgggttagtttgggttacgttaacttttaagtttttaacgtagttttcgacgttacgttaacggtaactttaacggttcngttacgttttcggtaaccgtttacggttccggggaaccggttacggtaccgttacgttaccggtacgtaacgtaacctaacggtaaaccgg

SEQ ID NO: 105639 - DNA, 609 bp, Homo sapiens
  misc_feature: GYAE6OF02FTTJO.29.71.G05.1.454.CMB.1.raw
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (394)..(394): a, c, t, g, unknown or other
  misc_feature (394)..(394): n is a, c, g, or t
  modified_base (602)..(602): a, c, t, g, unknown or other
  misc_feature (602)..(602): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctgtcccgtcacccctggacacgccggcctccactcctcctgcaagtctagtcagacgcctcgtgcaattagtgactggaaacacctaatagtgtactggtacctgcagtaagtnacggccacgcctaccacgacctctagtattttanggtaagtttccaaggtcgtttagtttggaagtcgcctaagcgtaagggtcctacgtacggtcggngtacggggtcgggttagaaacggggtactaaggttcctttaacgactaacgtaagtaaacgtcgacgggaccggggttgacggtcgtagggaacgggtacgtttaggatttatttaagttacgtagctagttagacctttaaagttccgagttcgtcgttacgttacgttacggacgtagggtactcgttaccgaggaactaccgtanaaaccgg

SEQ ID NO: 105640 - DNA, 658 bp, Homo sapiens
  misc_feature: GYAE6OF02FPQUB.29.71.G05.1.454.CMB.1.raw
  modified_base (157)..(157): a, c, t, g, unknown or other
  misc_feature (157)..(157): n is a, c, g, or t
  modified_base (216)..(216): a, c, t, g, unknown or other
  misc_feature (216)..(216): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattganatgacccagactccactctctctgtccgtcaccctggacagcccggcctccatcctccngcaagtctagcagacgcctcgtgactatagtgatacggaaatacctatatagtactgtacctgacgagtagtcacggccacgcctcaccgtactcctagtatttagtacgttaacgttaccaaggttcgtttagttttaggagtccgaccagtaacgacggtctacgacgggttgggaccgagggtccgggtacggaacgggtacgtacgttaactttaccgaacgttaacgtaaacgaaaacgtccggtaacgggcccgggggttaggaccgggtacgtagggaagggtacgtttaggggttaggtactttaagttttagttagttgtaactagttacgttaagttaacgtttacgagttccgtttaacggttaccgttttaacggttccggtaacgggtacgggtacctacgtacggtacgtaactactaacgtaaacgg

SEQ ID NO: 105641 - DNA, 698 bp, Homo sapiens
  misc_feature: GYAE6OF02F51YY.29.71.G05.1.454.CMB.1.raw
  modified_base (219)..(219): a, c, t, g, unknown or other
  misc_feature (219)..(219): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgctctggatacctggatccagtggagatattgagatcgacccagactccactctctctcgtccgtcacccgtgacacgccgcctcatcctccngacaagtctagtacagcgtcctcgtgactataggtagaatagggaaaactaccttaatacgttagtactacggtacctgacgtaaggtaacgtcgaacggcctaacgccctaccaacgtaccttcgtagtaacttttactacggtaaacgtttaccgaagttacggttttagttttaggacgtcgtaccgaagtaacgtacggtctacgaggtcggtacgaggtacgggtacgaacgggtaacgtacgttactttacaacgtaaacgtaacgtaaaactccggaacgggtacggggtacggtaacgggtacgtaagggaaggtaacgttaggttacgtaacgtttaagtttaagtttacgttacgtacgtaagttacgtaagttaaacgttagtacggttacgtttacgttacgtttaccggtttacggtaaccggtaccggtaaccgtaccgtaccgtacggtaacgtacgtaaaccg

SEQ ID NO: 105642 - DNA, 656 bp, Homo sapiens
  misc_feature: GYAE6OF02JJB4N.29.71.G05.1.454.CMB.1.raw
  modified_base (580)..(580): a, c, t, g, unknown or other
  misc_feature (580)..(580): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatattgagatgacccagactccactctctctcgtccgtaccacccctggacacggcccgcctccactcctccgtgaccaagtctagtcagacgcctgtgcgtatacgtgactaggaaacgacctatagtgtactcggtacctgacgaagaacgtcacggccacgccctaccacgtacctccgtagtaatttcgtagtaacgtttacccaaagttcgttttaagtttcggaacgttcgtaccaggactacgggccttacgaggtcggacgaggccggggttacgaaggggaccaggttactttaccaacgtaacgtaagtaaacgttcggaacgggttccggggtagggtaacggtcgtaggacgggtagttcggttaggtactttaagttttacgtattcggactaagttcgtaacgttaagttaccgngttccgttagttacgtaccggtttacgggacccggttaagggtaccctaggttcccgtaggtaaccctataacggg

SEQ ID NO: 105643 - DNA, 681 bp, Homo sapiens
  misc_feature: GYAE6OF02HF1MZ.29.71.G05.1.454.CMB.1.raw
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (502)..(502): a, c, t, g, unknown or other
  misc_feature (502)..(502): n is a, c, g, or t
tcagatagagtactcacgaccggtgctcgatttagtgtcgtcgcaagagagaggggactgatcaggacttctcagttcatcttctcaccatgagcctccctgctcagctccgtggggctgactaagtgcttcgtggactaccgtggtatccaggtaggagtattattggaagtagcgacccagacttccattcctctcgttcggtaccctcctacccgtaggaccgacggccccggtcccttacgacgtccttaccgtaggactaaacgttctacgttcgaaacgtcgtcccgtgtcgtacgtagtacggttagacgtaagggtaaataccgttagtaatgttacgtcgtaccgtgacagaacgtcacggtccaccgtcncccacgtacctaccgtntacttactagtaacttctacggtatttttaggtagtgtcgacgtacgagtacgtacagtaggtcgcgtaggtcggagtcggaacgtataccgttacagacgtaanaacgtcgggacgtgggtaagcgtgaagggtcgtacgttaggggttctaacgttacggttttaatgggtttaccaaagttgtaaacgtttaagtaacggttttcaacgtttcttacgggtttatccgggtttacggacggttaccggacgttaccgtaggtacctactaccggttaaacg

SEQ ID NO: 105644 - DNA, 688 bp, Homo sapiens
  misc_feature: GYAE6OF02JEOG6.29.71.G05.1.454.CMB.1.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
tcagatagagtactcacgaccggtgctcgatttagtgtcgtcgcaagagagagggggactgatcaggacttctcagttcatcttctcaccatgaggctccctgctcagctcctggggctgctaatgctctggatacctggatccagtggagatatgagatgacccagactccactctctctgtccgtccaccccgtggacagcccgcctccatcctcctgcaagtctagtcagacgcctgtgcatagngatggaaancctatatgtactggtacctgcagagtcaggccanccctacacgtactcctagtatttatagtaacgtttccgaagttccgttttagttttagggacgttcgacccgtaaggtacctacgggtccttacgaggtcgggaccgtaagggtccgggttacgaacggggaacctaggttactttaccaacgtaaccgttaacgtaaaactccggaacgggtaccggggtacgggtaacggtaccggtagggtaacgggtacgttacggttacgggtactttaagtttttaagtttagtttcgtacgttaagttacgtaaaccgttaacggttttaccacggtttcgtttacggttaccgtttaccggttttacgggaacccggttaccggggtaaccttaccggttccggtaacggtaccgtaacgttaacccgg

SEQ ID NO: 105645 - DNA, 819 bp, Homo sapiens
  misc_feature: GYAE6OF02JCLE8.29.71.G05.1.454.CMB.1.raw
  modified_base (217)..(217): a, c, t, g, unknown or other
  misc_feature (217)..(217): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgactcgagtcgtcgagggtnctgctggacggcttaggtaggtcgtccttcgtttccgttagacttaagtcgtccgttacgtaggtaaccttaccggtacggtacgttaccgtagggtaggtataagtttagttaggaacgtacgtaccgaacccgtacgtaccctacctccttccgttccttcgtacccgttacccgtaccccgtaacccggtggtaacccgccggtcccgtacccttccgtacgtcccttccgaacgtaccgtacgtacgtacggacgtaaccgtcgtaccgtcggacgtaacgtagttacggtaggtaaacggtaaaccggttaaaacgtactttaaagttacggttaacggtaaccggtttccggtaccgttaggaacccgtaaaggtaaccggaccgtacccgggtacccgacccgtaacccgttacccggtaacccttcccgttaacgttagtttaaaccgtttacgttaaccggtttaaaccgttacgtttaaccggtttattttacggggttaccggtacgtaacccgtaacggaaccgttacggtaccggttaccgtaacggtcgggtaaccggtacgggacggggtaccggtaacggtaacgg

SEQ ID NO: 105646 - DNA, 732 bp, Homo sapiens
  misc_feature: GYAE6OF02H6MIV.29.71.G05.1.454.CMB.1.raw
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcgaggccctgagtgggtgacttcgacaggcgtagtactttgtgtttctcgtagtctgtctttgctcagcgtgagggtcgcttgcgtagcggtcgttggtacggtgtcttcggttaccttgacgttatcgcttcgtaggtaactaccgtagactaccgtagggtaggtaagtaagtttaagttcgaagtacgtaccggaaccccagtaccctacctcgtccttaccgtccgttacgttacccgtccccgtacccgtcggaccgtaccggcccgtacccgtaacctacgtccttaccgctaaccgtaaggtccttaagggacctaacggtcgttccgttaggtaccgtacgtaaggttggtaacgtaagtaaacgggtaacctaacgttaaagttcgtacggttacgtaccggtataccgaacgtaaggactacggcgtacctacgtccgtaccaaccgtctacgttagttacctttagttacgttaacgttacgtaacgtttgttacgtttagggtaccgtcgtaacgtaccggtaacggttacctaccggttaggaacggtccgaccgggacggtttcggggacccgttaagg

SEQ ID NO: 105647 - DNA, 583 bp, Homo sapiens
  misc_feature: GYAE6OF02FYZYH.29.71.G05.1.454.CMB.1.raw
  modified_base (217)..(217): a, c, t, g, unknown or other
  misc_feature (217)..(217): n is a, c, g, or t
  modified_base (260)..(260): a, c, t, g, unknown or other
  misc_feature (260)..(260): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgtctttgctcagcgttcgaggggtncgtgtctggaggcttggtaggtgcttgtccttgctaatcgctntggactcctggactccaggtggagtattattcggagtactacgaacccagacctccgacttctctctcgtccgtaccacccgtgaacctcgccgtcctacntcctcgtnaccgagtctagngagtcctcgtgnctatagtagagtacggaatactaatgtacccccgtagtacgtcgtgaacgaacgtacgtacgacgaccaccgtccctaccgaacgtcctcgttattagttatacgtaacgttaccgtagttcgtttagttacgtcgtcggtaccacggagtcgacgtacgtaggcgacggacgggtacggtcggtaacgg

SEQ ID NO: 105648 - DNA, 653 bp, Homo sapiens
  misc_feature: GYAE6OF02IYJPB.29.71.G05.1.454.CMB.1.raw
tcagatagagtactcacgaccggtgctcgatttagtgtcgtcgcaagagagaggggggtgatcaggacttctcagttcatcttctcaccatgaggctccctgctcagctcctggggctgctaatgctctggatacctggatccagtggagatattgagatcgaccagactccactctctctcgtccgtccaccccgtggacacgccggccctccactcctcctcgactaacgtctagtcagacgtcctcgtgactagtaggtagagtaggaaacgtaccttaattatcgtacgttcggtaccgtgactaggaggtccgaggccacgccctaccgaccgtacctcctagttactttaagtacgttaacgtttaccaaggtttcgttttagttttcgggattcggaccgaacggtacgtacggtcctacgcggttacgggcgaacggggtccgggtacgagggtactagtacttacgactacgtaagaaacgtcggaggtcgggtagtaggcgtaggagtagtggttacgatttagtttattagtcgtagtagttagaacttaagtttcgacggttcgtttacggttacctttaccggtttagggaccggttacgggtacctcggttaccgaaggtacctacgtacgtaaaccgg

SEQ ID NO: 105649 - DNA, 708 bp, Homo sapiens
  misc_feature: GYAE6OF02JP90N.29.71.G05.1.454.CMB.1.raw
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (310)..(310): a, c, t, g, unknown or other
  misc_feature (310)..(310): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagatagagtactcacgaccggtgctcgatttagtgtcgtcgcaagagagagggggtcaggctggaactgaggagcaggtggggggcacttctccctctaacactctcccctgttgaagctctttgtgacgggcgagctcaggccctgatgggtgacttcgcagggcgtagtacttttggtgtttctacgtagtctgtctttgctcagcgtcgaggggtnctgctaggacggcttaggtagggtcncttgttcccttagctaagtcggcctacgtggtactaccggtgactcgagtggatattatgatnacgaccatcctccactctctcgtacgtccctcctacccttgacgaccgccggtaccctcagttccctctacgactaacgtctacgacgtaacgctccgttcggacncgtaagttaggtanaacggtagggaaaacgtaccttaagttaacgttacgttaacggtacgtacgtacgtaacgacgtaacgtccggacgtaacccgctaccccgtaccgaccggttacctttaccggttacgttaagttttaacccgtaggttaaacctttacccggtaacggtttacgtttttacggtttaagggtacgtacggtaacccggtaacgggtaccggtaacggcctttaaccgggtacggtttacgggaacggtcgggggtccccggttaagggtaacgggg

SEQ ID NO: 105650 - DNA, 804 bp, Homo sapiens
  misc_feature: GYAE6OF02FVJR8.29.71.G05.1.454.CMB.1.raw
tcagatagagtactcacgaccggtgctcgatttagtgtcgtcgcaagagagagggggactgatcaggacttctcagttcatcttctcaccatgaggctccctgctcagctcctgggctgctaatgctctggataccgtggatccagtggagatattgagatcgacccagacctccactctctctacgtccgtccaccccgtaggacacggcccggacccgttccagttccctacctggactaacgttactacggtacaggtacggccttcggtagacctagttaggtacggtaattacggggaaactaaccgttaagttacgtacggtaaccggttacgggtaacccttcggaacggtaacggtaaccggttacgaacgggtaccctacgggtacccccttaccgaacgggtccttaccgtagttaactttagtacgttaacgttaccaaggttacttttaggtttacggagtcgacccaagggactacgggtcttcggaacggttcggtaccgtacgggtacgggacggtaacgggacgttaacggtacgttttaccaacgtaaccgtaagtaaaccggttacgaaccggggttcggggtaaccggggtacggtacggttacgggaagggttcggttacggtacggttacgtttaagttttcgttaagttcgtaaacctagttaccgtaacgttaacgttttacgtaacggttcgtttacggttaccgtttacggtttacccggtacgggtaaccgggttacccgtaccggttacccgtaggtaaccccgttaagtaaacccg

SEQ ID NO: 105651 - DNA, 651 bp, Homo sapiens
  misc_feature: GYAE6OF02GUL8T.29.71.G05.1.454.CMB.1.raw
  modified_base (172)..(172): a, c, t, g, unknown or other
  misc_feature (172)..(172): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (287)..(287): a, c, t, g, unknown or other
  misc_feature (287)..(287): n is a, c, g, or t
tcagatagagtactcacgaccggtgctcgatttagtgtcgtcgcaagagagaggggggtcaggctggaactgaggagcaggtggggggcacttctccctctaacactcctcccctgttgaagctctttgtgacgggcagctcaggccctgatgggtgacttcgcaggcgtanactttgtgtttctcgtagtctgtcctttgctcagcgtcagggtnctgctgaggctgtaggtnctgtccttgactaatgctcgtggataccgtggtatccagttggatatagtganatcgaccagactccactctctctcgtccctcaccccgtggacacgccggtcctacactcctctgactacgtctagtaccagtacgccttcgtacgtcctataggtagacgttaagggaaacctactatagtacgttacgtcggtaaccttggactaaggtaacgtaccgacggtccgaccgtccctaccaaccggtcccttaccgtagttaacttttacgtacggttaaccgttttaccgaaacgggtttcgttttacggtttacgggtaaggttaccggtacccggaaacggtaccggtaacggtccgttaccggttagggttccgggaaccgtaccggggtaccgggttaaccggaaccggg

SEQ ID NO: 105652 - DNA, 616 bp, Homo sapiens
  misc_feature: GYAE6OF02FR74G.29.71.G05.1.454.CMB.1.raw
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagacctcccactctctcttcgtccgtccacccctggaccagcccggcctccatcctcctgcaagtcctagtcagactccgtcgtgccatagtgataggaaacgtaccctatagtgtacgtggttacctgcagaagtcacggccagccctcacgacctcctgatttangtaagtttccaaggtctttagttttgggagtcgaccagaccgnggtctacgaggtggccagggtccgggtagagggactaggtacgtttcaactaacgtacgaaaacgtcgaacgggtccggggtaggtacggtcgtaggaggtaggttgggttagtagttattttaacgtttagttagtactagtacgtaacgttaaagttacgtacgtgtttacgtttacgttacgtttccgggaccgacggggtaccttacgtacccggtaggtacctagtacctaaaccgg

SEQ ID NO: 105653 - DNA, 773 bp, Homo sapiens
  misc_feature: GYAE6OF02H8XQ4.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggataccgtaggactccaggtggagatattgagatgacccagacctccactctctctcgtccgtcacccccctggacacgccggcctccactctctcgacaacgtctagtacagacgtcctcgtcgacagtaggtagtagtaggaaacgtaccgttaatagttacggttacctacggtacctagacctaaaggtaacgttcgaacggaccaccgacccttaccgaaccgtaccgttaccgttagttaactttacgtacgttaaacgtttacccgtaaagggtttaccggttttaagttttacgggacggttaacggacccgtaacggtaaccgtaacgggtacttaccgggtaagggttcgggaccgtacggggtaccggggttacggaaccggggtaactaacgtttaccggtttaaccaacgttaacgtaaagtaaaacgttcggaaccggggtcggggtaggaacgtcggtaggaaggttgtttagggttcgaattttacgtttaattagttacgccttaaggtagttaaccgttaaagtttacccgtagtttacccgttaggtttaacccgttcgggtttcggaaccggaccgggttacctaccgggttccggtaaccgtactaaccgtaacggtaaccgg

SEQ ID NO: 105654 - DNA, 703 bp, Homo sapiens
  misc_feature: GYAE6OF02GQW49.29.71.G05.1.454.CMB.1.raw
  modified_base (259)..(259): a, c, t, g, unknown or other
  misc_feature (259)..(259): n is a, c, g, or t
  modified_base (510)..(510): a, c, t, g, unknown or other
  misc_feature (510)..(510): n is a, c, g, or t
tcagatagagtactcacgaccggtgctcgatttagtgtcgtcgcaagagagagggggtcaggctggaactgaggagcaggtgggggcacttctcccctctaaacactctcccctgttgaagctctttgtgacgggcgagctcaggccctgatgggtgacttcgcaggcgtagactttgtgtttctcgtagtctgctttgctcagcgtcgagggtgctgctgaggctgtaggtgcgtgtcctgacttaagtcgcgttccnggtactaccgtggactccgaggtggtaagtattagttggagtacgtacggaacccgacgtacctcccgtacctccttccgtcgttcgtcccgcccgtaccccgtacgggacgaccggccccggtccctcctacttaccttccgtcgaccgtaacgttaccgttagaccgaacgtaccgtccgttacgtcgtacgtagtaggtacgaagttaacggaaactaacctagttacgtacggttacgtacgtacgngaacgacggtacgtaccgcgaccctacgcccgaccgtaccgtaccttcgtagttacgtttacgttaaccggttaacgttacctaacgggtttacttttaggttacgggacggttccaacggttaacgtccggtaacggttaccgtaagggtccgggtaccggtaccgggcggggttaccgggtggaaacccgg

SEQ ID NO: 105655 - DNA, 793 bp, Homo sapiens
  misc_feature: GYAE6OF02IJN1P.29.71.G05.1.454.CMB.1.raw
tcagatagagtactcacgaccggtgctcgatttagtgtcgtcgcaagagagagggggtcaggctggaactgaggagcaggtgggggcacttctccctctaacactctccctgttgaagctctttgtgacgggcgagctcaggccctgagtgggtgacttcgcaggcgtagtactttgttgtttctcgtagtctgtctttgctcagcgtcgagggtgctgctggaggcttggtagtgcttgttccttgactaatcgtctcgtagactacgtggactcgaggtggaagtattagttggagtacgtaccgaacccacgtacccttccaccgttccttaccgtttccgttccggttccccgtaccccgtaccccgttacgggaccgaccggtccccggtaccccttccgtaccttcccgtccctagtaccgttaacggtcttaacggtaccgtacgtacccgtccgttcggtacgtacgttaagttaacggttcgtaaacggttaaacgggtaaaaccttaccgtttaaagttaggtttaaccgggtttaaccggttccggtttaacccacggttaaccgtaaacgggtacgttaaccgggaccgttaacccgaccctttacccgtaaccgaacccgtttacccgttcgtttaaggtttaacttttaaacgttaacgggtttaacgtttaacccggttaagtttcgttttttacggttacggacgttaccggaccgtaaggtaacctcgggtcttaacgggtcgggtacgaccgggtggtaccgggttaggaaccgg

SEQ ID NO: 105656 - DNA, 785 bp, Homo sapiens
  misc_feature: GYAE6OF02FT90O.29.71.G05.1.454.CMB.1.raw
  modified_base (107)..(107): a, c, t, g, unknown or other
  misc_feature (107)..(107): n is a, c, g, or t
  modified_base (128)..(128): a, c, t, g, unknown or other
  misc_feature (128)..(128): n is a, c, g, or t
  modified_base (150)..(150): a, c, t, g, unknown or other
  misc_feature (150)..(150): n is a, c, g, or t
tcagatagagtactcacgaccggtgctcgatttagtgtcgtcgcaagagagagggggactgatcaggacttctcagttcatcttctcaccatgaggctccctgctcngctcctgggctgctaatgctntgatacctggactccagtgganatattcgagatagaccccagactacccacttcctcttcagttcccgtaccaccccgttggaaccaccggccccggtctcccgaattcccgtaccgtgactaaagtcttaggtaccaagtacggtcccttcggtcgacctataaggttactaaggttacggaaacgtacctaacttagtaccggttaacttcgggtaaccgtgacgaacggtaacgtaccgacgggtccctaacggcccttacccacggtaccttaccgttggaaactttttcgacgtttaaacgttaccgaaggttaccggttttagtttttaccgggatttaccggacccgaagttaacccgacgggtacccgttcggtaaggtcgggtaaccgtagggtacccgggttacggaacggggtaacctaggttaaccttttaccaaaccgtaacgtaaagtaaacgttaccggaaccgggtccgggttaaggaccgggtacgtacggtaacggggtagttacgggttccgtactttagtttaaaccgttagtcgtaacgttaacgtgttaaaaccgttaccgtttaagaccgttcgttaccttacggtacctttgggaaccgtacggaacggttctaccgtaacgcaccttaacgg

SEQ ID NO: 105657 - DNA, 666 bp, Homo sapiens
  misc_feature: GYAE6OF02HE7KB.29.71.G05.1.454.CMB.1.raw
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctgctttgactcgagcgtcagggtnctgctgagctgtggtnctgtcctgctatgctctggatccgtaggactaccgagttggacgtatagttgagtatacgaaccccagtacctccgtacttcgtcctctcgtccgtcccacccgtagaccgtacggcccggtacctcccaacgttccctccgtcgtaccgtaacggttcctagtaccgacgtaccgcccttggtcgctaagtacggtaggtaacgtaacgggtaaactaaccctaagttacgtacggttaaccgttcggtaacccctgtacccgtaacggtaacgttccgaggcccgtacgtcccgtccgtaacggacccttcgtgttaactttacgtgtttaaaccttacccgtaaggttccgttttaggtttcggacgttccggaacctagggacgtcgggtacttacgcgggttaccgacgacgggttcgggactaacgggg

SEQ ID NO: 105658 - DNA, 832 bp, Homo sapiens
  misc_feature: GYAE6OF02IGH3Y.29.71.G05.1.454.CMB.1.raw
  modified_base (599)..(599): a, c, t, g, unknown or other
  misc_feature (599)..(599): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgtctctggatacctggatccagtggagatattgagtatacgaccagacctccactctctctcgtcctccacccgtgacacggccgtcctccgacttcctacctgactaagtccttagcagacgtcctcgtacgactaagttacgtagaagtaggaaacttaacgttattaaacgttcgtacggttccgtaccgtagagaacggtacgtaccgacggaccaccggtcccctacctaaacgtccctttaccgtaatttacgttttaaacgttaggtttaaaccgtttacgtaaacgggttttccgttttttaaagggtttcgttaaccggtaccgtaacgtaacgggtaacgtaacggttccttaagggacggtccgggtacggaacggggtccgggtaaacggacgggtaactaaacggtttacttaaccgtaacgtaaagttaaacggtaaactccgggtacggggttaccgggnggggttaaaccgtgggtaagggtaacggtaggtttacggtttacgggtaatttttaaaggtttactttacggtaaccgttagtaattacgttaaacgttacgttttacggactttttccggggtttaacctttacgggttttaaccggggtttaccggacccggggtttaacggtaccctttaacggtaaccccggtttacggaaccctttaaggttaaaccccgttaacggg

SEQ ID NO: 105659 - DNA, 766 bp, Homo sapiens
  misc_feature: GYAE6OF02FNUZP.29.71.G05.1.454.CMB.1.raw
  modified_base (105)..(105): a, c, t, g, unknown or other
  misc_feature (105)..(105): n is a, c, g, or t
  modified_base (134)..(134): a, c, t, g, unknown or other
  misc_feature (134)..(134): n is a, c, g, or t
  modified_base (146)..(146): a, c, t, g, unknown or other
  misc_feature (146)..(146): n is a, c, g, or t
  modified_base (153)..(153): a, c, t, g, unknown or other
  misc_feature (153)..(153): n is a, c, g, or t
tcagatagagtactcacgaccggtgctcgatttagtgtcgtcgcaagagagagggggtgatcaggacttctcagttcatcttctcaccatgaggctccctgctcngctccgtgggctgctatgctctgataccnggatccagtganatatgantcgacccagacctcctactcctctcctcgtcccgtccaccccgtaggaccacggccccggtccctccacttccctccgtcgcctaacgttcgttacgccaagccgtccgttacgtcgactagtacggtagtacgttaacgggaaactaccttaatacgttacggtaccttacggtacctgactaacgtacgtcgaccgtaccaccgtcccctaccgaacttacccgtcgtagttaactttacggtaacgtttaccgtttaacgacggtttacgtttacggttacggacgtccgaccgtaaccggacgtacggtcctacggtcggtcggtaccggtacggtaccggtacggtaaccggtacgtacgtaaccttaccgtaaccgtaacgtaaacggtaaccgtaccggtaccggttaccggggtacggtacgtaccggttacgggtaacgttacgggttacggttaccgttacgttaacttttaacgttacgttaccgtactaacgtacgttaaccgttaacgttacgtaccgttacgtttacggttaccgtaccggtttaccggaccggtacggttaccgtacgtaccgttacaccgtacgtaaccgtaaccgg

SEQ ID NO: 105660 - DNA, 780 bp, Homo sapiens
  misc_feature: GYAE6OF02F4HP1.29.71.G05.1.454.CMB.1.raw
  modified_base (362)..(362): a, c, t, g, unknown or other
  misc_feature (362)..(362): n is a, c, g, or t
tcagatagagtactcacgaccggtgctcgatttagtgtcgtcgcaagagagagggggtcaggctggaactgaggagcaggtgggggcacttctcctctaacactctcccctgttgaagctctttgtgacgggcgagctcaggccctgatgggtgacttcgcaggcgtagtactttgtgtttctcgtagtctgtctttgctcagcgtcgagggtgctgctggagtctgtaggtgctgttcctgactaagtgcttgtggtactacgtggacttcgaggtggatacttattggagtagtacgaccctagtacctccgtaccttcgtaccttcgtaccgttcccgtaccctacccgtaggtaaccncccgggtcccggtcccctacgtacccttcccttaccgtacggaccgttaaacgttcttacggtaaccgaacggtacccgttcccgttggtaccgtacgtaaggtttaccgtaggtaacggtaaacgggtaaaaccgtaccttaaagtttacggttacggttaccgttacgggtacctcgaacggtaacgtaacggttaccgaccggtacccgtaccggttacccccgtaccgtaacccgttacccttccgttaacgtttaacgtttaacggtttaaaccggttaaccgtttaaccgttaacgttttccgtttttaacgggttacggtaacccggttaacgtaacccgttaacggaccgtacggtacccgttagggtacggttaccgtacggaccgggttaccggggtaggtaaccggg

SEQ ID NO: 105661 - DNA, 752 bp, Homo sapiens
  misc_feature: GYAE6OF02HBCAC.29.71.G05.1.454.CMB.1.raw
  modified_base (229)..(229): a, c, t, g, unknown or other
  misc_feature (229)..(229): n is a, c, g, or t
  modified_base (329)..(329): a, c, t, g, unknown or other
  misc_feature (329)..(329): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggataccgtggactccaggtggagatattgagatcgaccagacctccactcttctcgtcgtccgtccacccgtggacgcgccgccctaccactcctccgngactaacgtcgtagtacgagtaccgtcccgttacgcggtactaagtaggtacggaaagtaacggaaacgtaccttaattagttacgttacgtcggtaccngaacaagacgtacgacggaccaccgtcctaccgtaaccgtcttccgttaagtttaacttagtaccggtttaaactttaccgtaacggttttacggtttttaggttaacgggtaccgtacggtaacccgttaggaaaccgtcggttacctagggtaacggttcgggaccggtcggggtaccggtacgggacggtaaccgtaggttacgttaccaagttaacgaaacgtaaacgtagggaccgggtacgggggtaacgtagggtacgtggggtaacggtgttacgggttacgttatttaacgtttagttacgttcgtagtagttaacaagtttacgttacgtaggttcgttacgttacggttacggttcggtaaccggtacggtaccgttaccgtaacgtcggaaccttacggtaaccgtaacgg

SEQ ID NO: 105662 - DNA, 619 bp, Homo sapiens
  misc_feature: GYAE6OF02FNMXB.29.71.G05.1.454.CMB.1.raw
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
  modified_base (473)..(473): a, c, t, g, unknown or other
  misc_feature (473)..(473): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgtctttgctcagtcgtcagggtnctgctgnggctgtaggtgcttgtccttgactaatgcttcgtggatacctggactcctaggtggaagtattattggagagtacgacccagtacctccacctctctctcgtccctcaccccgtgacacgccgcctcactctctnacgtagtctagtacagtccgtcctgtacncattagtagaagtaagggtaaactaaccttaagtacgtacgttaccgtacgttacgtnacgaagacgtcgacggtaccacggtacccncgacgtccttctaagttacttttaagacgttaaaccgtttacgaacgtttcggtttttaagttcgggtagttaaccgtaccaaggaaccgttcggactttaacggcgggttaaggccggtaagggttcccgggagtaaacccgggg

SEQ ID NO: 105663 - DNA, 646 bp, Homo sapiens
  misc_feature: GYAE6OF02JJP18.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatcgacccagactcactctctctcgtccgtcaccctggacacgccggcctccatctcctagcaagtctagtcagacgcctcgtgctatacgtgagtaggaaacgtacctaatactacggtacttacggtaccgtggacgaagtaacgtacgacggaccacgccctaccgactaccgtcctagtatttagtacgtaacgttacaagttcgtttagtttacggagtacgccgaagacgcgtactacgtagtcggacgtacggtacggtacgaagggtacagtacttacgaactaagtaagaaactcggacggtacgggtaggtaggtacgtaggacggttacgttggttacggtacgtttaagttttaacttacggttacgactagttacgtaaacgtttaagttaccgagtttcgtttaacttaccgttaacgggttttccggacggttaaccggtaccttagtcggttaacgactacgtacgtaaacgg

SEQ ID NO: 105664 - DNA, 617 bp, Homo sapiens
  misc_feature: GYAE6OF02JBAXM.29.71.G05.1.454.CMB.1.raw
tcagatagagtactcacgaccggtgctcgatttagtgtcgtcgcaagagagaggggtgatcaggacttctcagttcatcttctcaccatgaggctccctgctcagctcctggggctgctaatgctctggatacctggatccagtggagatattgagactgacccagactcactctctactgtccgtcacccctggacacgccgctccatctcctgcaagtctagtcagagccctcgtgacacgtaagtgataggaaagacctatatgtactggtacctgcagaagtcaggcagcctccacgacctctagacttatcgaagtttccaagtcgttatttggaagttcgctaagaccagggtacctcgtaggtaggccgaagggtcgggtacggaacgggacgaacgggtactttacaacggtactaggaaaacgttaccaacggtaccgggttacgggaagggccgttaggaacgggaggttacggtgggtacgtattttaaggttaagttcgtatacgttgaacgtaaagtttaccgaagtaccgtttggtacttaacgttttcgggaccgtacgggaaccgttacgtcccgtttacggactaacgttaccgaaaacg

SEQ ID NO: 105665 - DNA, 658 bp, Homo sapiens
  misc_feature: GYAE6OF02IOMU0.29.71.G05.1.454.CMB.1.raw
  modified_base (117)..(117): a, c, t, g, unknown or other
  misc_feature (117)..(117): n is a, c, g, or t
  modified_base (125)..(125): a, c, t, g, unknown or other
  misc_feature (125)..(125): n is a, c, g, or t
  modified_base (145)..(145): a, c, t, g, unknown or other
  misc_feature (145)..(145): n is a, c, g, or t
  modified_base (167)..(167): a, c, t, g, unknown or other
  misc_feature (167)..(167): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
tcagatagagtactcacgaccggtgctcgatttagtgtcgtcgcaagagagagggggactgatcaggacttctcagttcatcttctcaccatgagctccctgctcagccctggcgtnctatacgngtctggtactcgatctacgngtgatattagcgatgaccgacncgtctactcgtctcttcncctccgcccncggtgacnccgtccgtacctacncgtcctcgagtaataccgntnacgtanccncggtntcgattagtgtacgtagtacgtaactatactgtactcgttacgtntacgganaacggtacgtacgcgtacgccttaccaaccggtcctcctnttaacgttatcgtaagttcccgtacgttagttacttttaggngtacgtcgaacaacgtcgtacttgagtcgtacgnggtacggtcgtacggacggtaatcgttctaccagtacgtaaactaagtacggccgggaggtcggtacttaggaggacggttgttacggtacgttaacgtttattaacgtttcggtaatacggtaagtacggttaaacgttacgttacgttaccgtgttaccgtttaaacgttcccggtaacgtaccggggtaccctaccggttaccgtaccggtaaccgttacaaccgttaaacccg

SEQ ID NO: 105666 - DNA, 642 bp, Homo sapiens
  misc_feature: GYAE6OF02HE464.29.71.G05.1.454.CMB.1.raw
  modified_base (345)..(345): a, c, t, g, unknown or other
  misc_feature (345)..(345): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgcgtgaggctggtaggtgtctgttcccttgacttaatgctcgtggactaccgtggactccgaggtggatattattgagtatacgacccagacctccacctctctcctcgtcccgtcccaccccgtggaccncggcccggtccctcccacttcctccgtagtaccgtaacgtcttacggtacacgacgtcccttcggtacgctagtacgtgacgtaacgggaaactaccttatacgtacgttacgtcggttacctaggacgtaaggtaacgtaccgacggccctacgccctcccgaacctacctccgttagttaactttagtaacggttaactttaaccgaaggttaccgttttaggtttcggtacggttcgtaaccgtacgacggttacgtcgtacgagggtcgcggtacggcgggtacggtaacggg

SEQ ID NO: 105667 - DNA, 653 bp, Homo sapiens
  misc_feature: GYAE6OF02IG8GZ.29.71.G05.1.454.CMB.1.raw
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctcgtccgtcaccccgtggaccagccggcctccatcctcctgactaagtctacgtcagacgtcctcgtcgactagttagtgataggaaacgacctatagtgtacctaggtacctgacaagtaacgtcgacggccacgccctaccgaacgtccttccgtagttattttacgacggttaacgtttccgaaaggttcgttttaagtttcgggaattcggaccagaacgtcgggtctaccgaggtcgggactacgggtccgggtacgacgggtactacgttactttacgactaacgtaagtaaacgtcgtaacggtcggggtagaggtcgtaggacggtagttcgttaggtctttatttagttgtacgtactagtacgtaacgttaagtttacgacgttcgttacgttaccgttacggtttacggacccggtaacgggtaccctacgttaccggacggtaactaccgtaacgtaaccgg

SEQ ID NO: 105668 - DNA, 857 bp, Homo sapiens
  misc_feature: GYAE6OF02I3U07.29.71.G05.1.454.CMB.1.raw
  modified_base (377)..(377): a, c, t, g, unknown or other
  misc_feature (377)..(377): n is a, c, g, or t
tcagatagagtactcacgaccggtgctcgatttagtgtcgtcgcaagagagagggggtgatcaggacttctcagttcatcttctccaccatgaggctccctgctcacgctccgtggggctgtctaatgtctcgtggactacctggatccgagtggatatagttggagatacgacctagtacctcctactccttctccgttacgttcccgtaccaccccgtgggaacctcgggcccggtcccttaccgtacttcctccgtacgacgtaaacggttccgtaacgtacgtaacgggtctcccttgggtactaccgtaattaggtagtacggtaaggtaaaccgtacttactcggttacgttaaccgtacgggttaacccnggacgtaacggtaacgttaccggacggtaccctccgtacccgttaccccgaggttacccctacgttagggtaactttaccggttaacggttaaaaccggtttacccaaggtttaacccgtttttaggtacgggttaaacgttcgggaaccgaacgttaacgaggttacccggtagtacgggttccggaaggccgggtacggtacgtaacgggtaaccagttaaccggttacaacgtaaccgtaaacgttaaaccgtcggtaacggtaccgggtagggtaacggtacgggtacggtaggttaccgtttacgggttacgttaaccgtttaagtttacggttacgttaacgtaccgtagttaccggtaaccgttaacggttacgtaaccggtcgttaacgggttccttaacgggttcccggaacgggttacccgggactttaccggtacccggttaagaacggtttacctaaccgtaaaccgg

SEQ ID NO: 105669 - DNA, 730 bp, Homo sapiens
  misc_feature: GYAE6OF02GVNZB.29.71.G05.1.454.CMB.1.raw
  modified_base (212)..(212): a, c, t, g, unknown or other
  misc_feature (212)..(212): n is a, c, g, or t
  modified_base (380)..(380): a, c, t, g, unknown or other
  misc_feature (380)..(380): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcagctcaggccctgatgggtgacttcgcaggcgtagactttgtgtttctcgtagtctgctttgctcagcgtcgagggtnctgctgaggcttgtaggtcgtctcgttccttgactaatcggtcttcgtggtacttaccctggtaactcctaagggttcggaagtatttattaggaagtaacgtacggaaccccaggacccttcccaccttcctccgttctccgtttccgtacccaccccgtggacccncggtaccccggcccttccgaacttcctcccgtaggtaccaaaggttccttagtacccgaagtacgtcccctacggttacgaccgttaagttagggtacggaacgttaagggaaaaccgtaacccgtttaatacgttaggttaccgtacgggttaccctaggacgacgtaacgccggtacgccgaccgtccctacccaaccggtccctttcgttaacttagttttactaacgttaaccggttacctaacgttccggtttttagttacgggacgttacggaaccgacgtaacccggtacgtcctaacggttcgggtacggaccggtaccgggtccggtaacgggtaaccggg

SEQ ID NO: 105670 - DNA, 798 bp, Homo sapiens
  misc_feature: GYAE6OF02F4ZKJ.29.71.G05.1.454.CMB.1.raw
  modified_base (157)..(157): a, c, t, g, unknown or other
  misc_feature (157)..(157): n is a, c, g, or t
tcagatagagtactcacgaccggtgctcgatttagtgtcgtcgcaagagagagggggtgatcaggacttctcagttcatcttctcaccatgaggctccctgctcagctccgtgggctgctaatgctctgatacctggactccagtgacgatattganatcgaccctagactccacttctctctacgtccgtccacccgtggacacgcccggtcctcactcctaccgtcggactaacggttcctagtcagtaccgtcttacgtcgcgtaacttggtagagtacggtaaaacgtaccgtaattacgttacgtaaccgttacggtacctaggcgaaggtaacgtcgacgacgacggtcccaccgaacgtactccgttagtactttaatacggttactttaacgacgtttacgtttacgtttaggattcgaccgtaacgaacgtcgggttacctacggttacggtacggtacggtacgggtaccggggtcgaacggggtaccgtaagttaaccgttaccgtaaccgttaaccgtaaacggtaaaccgtacgggtaaccgggtccgggggttaacggtaacggtccggggtaaggtaacgggttaacgggtttcggttaacgggttacgttttaccggtttttaacgtttaaggtttccgttaacgttaacggttacgttaaacgggtttaaccggtttataaccggtttacggttacgttttaccggtttacggttacccgggttacgtaccggggtaccttaccggttacgttacgggtaaccttacgtaccgttaaacgg

SEQ ID NO: 105671 - DNA, 741 bp, Homo sapiens
  misc_feature: GYAE6OF02I9KUN.29.71.G05.1.454.CMB.1.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (446)..(446): a, c, t, g, unknown or other
  misc_feature (446)..(446): n is a, c, g, or t
  modified_base (628)..(628): a, c, t, g, unknown or other
  misc_feature (628)..(628): n is a, c, g, or t
tcagatagagtactcacgaccggtgctcgatttagtgtcgtcgcaagagagaggggggactgatcaggacttctcagttcatcttctcaccatgaggcctccctgctcagctccgtggggctgctaatgctcgtggataccgtggactccaggtggagatagttggagatcgacccacgactcccacttccttctccgtcgtcccgtccaccccgtggaccncggccccggtcctcctactcctccgtcgactagtctagacagcgtcctcgtncgataggtgagtacggaactactatacgtgttacgtggtacctgacgaaggtaccgacgacggccaccggcccctaccgtacgtacccttcgtagttaacgttttacgtaacggtttaaccgttaacgtaacggtttagtttttaggtttacgggacgtccgacgaggtacncggttctacgggaggtcgggacgacggggtccgggtaacggaacggtactagtttactacccaacgaaacggtaagtaaccggttcgggacgggttcggggtacggtacggcggttaacgggagttaggttcgggtttacgttagttttaaattcgtttaaggtcgtaaccttgggttaaanaaccgtttcgttaacgtcgtttccggttaacctttacgggttaaccgtttcgggggaacccgttaaccggtcctaaccggtttacccggaacgtttaaccgtcccgtaaacgg

SEQ ID NO: 105672 - DNA, 673 bp, Homo sapiens
  misc_feature: GYAE6OF02GCM4J.29.71.G05.1.454.CMB.1.raw
  modified_base (238)..(238): a, c, t, g, unknown or other
  misc_feature (238)..(238): n is a, c, g, or t
  modified_base (485)..(485): a, c, t, g, unknown or other
  misc_feature (485)..(485): n is a, c, g, or t
  modified_base (513)..(513): a, c, t, g, unknown or other
  misc_feature (513)..(513): n is a, c, g, or t
  modified_base (550)..(550): a, c, t, g, unknown or other
  misc_feature (550)..(550): n is a, c, g, or t
  modified_base (584)..(584): a, c, t, g, unknown or other
  misc_feature (584)..(584): n is a, c, g, or t
tcagatagagtactcacgaccggtgctcgatttagtgtcgtcgcaagagagagggggactgatcaggacttctcagttcatcttctcaccatgagctccctgctcagctccgtggggctgacctaatgcctcgtaggactaccgtggactccaggtaggatatagttgagatacgacccagtcctaccacttctctactcgtcccgccacccgtgacacggccgacctcacttcaccngactagtctacgagacgaccgtcctacgcatacgtagtgtaagaacggtaaacacttatcgtaggtacgtacgtaccgtagcgtaagtacgacgaccgaccgactccctaaccgactccgtacgttaacttaagtttacggtagttaaccgttacgttaacgttcgtttaaggtttcggaacggtcaaccgtagacgtcggcttacgagggccagacgggtccggacgagtacgtcttaacgtcaanacggaacaacgtggacggggcgtaaggngttgaagtaggtacgtggtactaactttattacggtntagttaccgaagttaatacccggttaagttccgngttttaaacgcccgttttagggtttaccccgaaggggtcccaaacggttttcccagttaaccgggtaacacccgttaataaaccccggg

SEQ ID NO: 105673 - DNA, 761 bp, Homo sapiens
  misc_feature: GYAE6OF02IAFAV.29.71.G05.1.454.CMB.1.raw
  modified_base (127)..(127): a, c, t, g, unknown or other
  misc_feature (127)..(127): n is a, c, g, or t
  modified_base (170)..(170): a, c, t, g, unknown or other
  misc_feature (170)..(170): n is a, c, g, or t
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (256)..(257): a, c, t, g, unknown or other
  misc_feature (256)..(257): n is a, c, g, or t
tcagatagagtactcacgaccggtgctcgatttagtgtcgtcgcaagagagaggggtgatcaggacttctcagttcatcttctcaccatgaggctccctgctcagctccgtgggctgctaatgctcngactacctggactccgagtggagtatattgagtatcgaacccngacctccacttcgtctctcgtccncctacccgngacnccgtccgcctcactcctcgngactacgtctacgtnagtcctccttcgtnntaataggtgtaagtaacggaaaccgtctaacttagtaggtaccgttacggaaccgttcgaccgtaagtacgtaccgaacgttccgaacctccctaccgactacggttcctagttagttacgtagtacgtaccgttaacggttcttttacggttagtaaccggtctaacgacggtacgacggtacctcggttacgtcggaaccgtcgggtaacggtccgtaaacgggttacgaagttccgttaaacgacgtaaacgtacggtaaaactccggtaaacgggtccgggttaaggtaccgggtagttaccgggaggttacgttcgggttaccgtacgttttaacgtttaacgttaaccgtttcgtaaaccggttctaaacgggtttaccgttaaaacggttccttacggttaccggtttaaacgttcccgtttacggttaccggtaaccggtaccggttaacccttcgggttacctaaccggtaacgttaacgttacccgtaaaaccg

SEQ ID NO: 105674 - DNA, 694 bp, Homo sapiens
  misc_feature: GYAE6OF02GGANC.29.71.G05.1.454.CMB.1.raw
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
  modified_base (540)..(540): a, c, t, g, unknown or other
  misc_feature (540)..(540): n is a, c, g, or t
tcagatagagtactcacgaccggtgctcgatttagtgtcgtcgcaagagagagggggactgatcaggacttctcagttcatcttctcaccatgaggctccctgctcagctcgtgggctgactaatgctcgtggactaccgtggactccgaggtggatattattgagactcgaacccagacctcctacttcgtccttctcggtacccgtccacccgtggaccacggcccgtaccctccacttcctcctagactacgtcgtagtacaggacctctacggcgactaagtgagtacgttaaggaactacttagttcttacggtaccgtacgtaccgtagaacgaaggttaccgcggaccgacnccgtaccncccggtaacgttaccttcgtaaggttacgttttagtacggttaaccttttaacggagttttacgtttagtttcggagtccgaacgtagagtcggtactgggtagcggagtcggcgtaggacgagtgttactcgaattacgaagtaccgtggaccggngggtagngacgttagngggtttgtacggttgtattttaagttattcgtagtacgttagtaagtttaacgttacgttaaccggtgtttcgttaacccggttacgtttaacggttccggaaacccgggtcggttacttaccggttacccggtagtaccgacggttaaacccg

SEQ ID NO: 105675 - DNA, 674 bp, Homo sapiens
  misc_feature: GYAE6OF02HI4QQ.29.71.G05.1.454.CMB.1.raw
  modified_base (206)..(206): a, c, t, g, unknown or other
  misc_feature (206)..(206): n is a, c, g, or t
  modified_base (475)..(475): a, c, t, g, unknown or other
  misc_feature (475)..(475): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctggatacctggactccgagtggagatattgagatcgacccagacctccactctctctcgtcccgtccacccgtggacncgccggcctccactcctcctcgacaacgttcgtacgtcgagacgtcctcggtgactagttagtgtagtaaggaaacgtactatagttgtacgtcggtacctgacgtaagaacgtcgacgccacgccctaccacgtacctccgtagttaactttagtacgttaacgttaccgtaagttacgtttagtttggacgtcgtacgaagtacgacggtctgagggtcggacggtacggccggggttaagaacggggtactaacgtccgtttaaanaaccgttaacgtaaagtaaaccgtcgtaacggggtccgggtgggaacggtcgtaggaggttacgttggttacgtatttagttttagtcttagctagttacgtaacgttaagttacgtgttaccgtttacgtacgtttaccggttaacggccgggtaacgtaccgttacgtccgtaaggtaactacgtaaccggtaaacg

SEQ ID NO: 105676 - DNA, 833 bp, Homo sapiens
  misc_feature: GYAE6OF02F59O3.29.71.G05.1.454.CMB.1.raw
  modified_base (156)..(156): a, c, t, g, unknown or other
  misc_feature (156)..(156): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
tcagatagagtactcacgaccggtgctcgatttagtgtcgtcgcaagagagagggggtcaggctggaactgaggagcaggtgggggcacttctccctctaacactctcccctgttgaagctctttgtgacgggcgagctcaggccctgactgggtnacttcgcaggcgtagactttgtgtttctcgtagtctgctttgcttcagtcgtcagggtnctgctggacggctgtaggtncttgtccttgactaagtcgctcgtggacttaccgtaggactccgaggtaggacgtatacgttgagtatcgaacccgacgtacctcctaacgtcttaccgttctaccggtccccgtaccctaaccccggttcggaaccggaccggtccccggtacccttcctacgttccgttccgtacgtacgttaacgttacgttacgtacgaacgtcccgtaccgttccgtacgtacgtagttacggtaggtaacggtaaacgggtaaacttaacgttaagttacgttaccggtttaacggttaccgggttacccttacgggtaccgtaaacggttaccggtaaccggtaaccgggtaccctaaccgggtaccccttaaccggtaaacccgttcccgttaaccgtttacgtttaaccgtttaacggttaaaccggtttaaacggttttaccgtaacgggtttttaaccgtttttaagggtttaaccggggtaacggttaaccggtaaccccggtaaacggttaccgggttaaccgtaacgggttttcccggtaacggggttaccgggaaccggttcgggggttacccgggtaccggggtaaaccggg

SEQ ID NO: 105677 - DNA, 648 bp, Homo sapiens
  misc_feature: GYAE6OF02GHKWR.29.71.G05.1.454.CMB.1.raw
tcagatagagtactcacgaccggtgctcgatttagtgtcgtcgcaagagagagggggtcaggctggaactgaggagcaggtgggggcacttctccctctaacactcctcccctgttgaagctctttgtgacgggcgagctcaggccctgatgggtgacttcgcaggcgtagactttgtgtttctcgtagtctgtctttgctcagcgtcagggtgctgctgagctggtaggtgctgtccttgctaatgctctggatacctggatccagtggagtatattgagatcgaccagacctccactctctctcgtccgtccacccgtgacacgccgcctccatcctcctgacagtctagtcagacgcctcgtgactagtacgtagtacgtagggtaaaactccgttaatacgttacggtaccgttcggtaacccgtgtacgtaacggtaacgtccgaacgggacccaacggtcccctccgaaccgtaccctcccgttaagttacttttaagttacgttaaaccggtttaccgaagggtttccgttttaacggttttcgggaacggttccggaaccgttaaccgggtaacgtaccgggtacccttacggtacgggtagggacccggacgggggtaccgggttacggaaacccgggg

SEQ ID NO: 105678 - DNA, 827 bp, Homo sapiens
  misc_feature: GYAE6OF02JO675.29.71.G05.1.454.CMB.1.raw
  modified_base (127)..(127): a, c, t, g, unknown or other
  misc_feature (127)..(127): n is a, c, g, or t
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (410)..(410): a, c, t, g, unknown or other
  misc_feature (410)..(410): n is a, c, g, or t
tcagatagagtactcacgaccggtgctcgatttagtgtcgtcgcaagagagagggggtcaggctggaactgaggagcaggtgggggcacgttctccctctaacactctccctgttgaagctctttgngacggcgagctacaggccctgactgggtgacttcgcaggtcgtagtacttgtgtttctcgtagtctgtctttgactcagcgtcgagggtncttgcgngacggtcgtggtagtgtccgttcgttccttgtactaacgttcgcctagttagggaactcccggtaggtaccttccgtaggtaggtaacgtacttaagttggaacgttaacgttccggaaccttaggtaccttacccgaaccgtttctaccggttctcttaccccggttacctaccgtcggtaaccncggaccccggttcctacctaccgttcctaccgttccggtaactaccgttacggttaaccgtagaccgttaaccggtcccttcggggtaactaccgtagtaacgggtacgtaacggtaacggtaaaccgtaccgttaagttaaccgttacggtaccgtttaaccggggtaacctcggtaaacgtaccggtaaacggttcccggtcggacccacccgggttaccctacccgtaaaccgggttcctaaccggttaaccggttttattttaaccgggttaaccgttaaacgggtttaacccctagtttaccccggttttagtttacggggtataaccccggtacggttaacggacgttaccggttacggtacccaaggggtttccaacgggtacgggtttacccggaccggttaaacgggg

SEQ ID NO: 105679 - DNA, 863 bp, Homo sapiens
  misc_feature: GYAE6OF02IZCSR.29.71.G05.1.454.CMB.1.raw
tcagatagagtactcacgaccggtgctcgatttagtgtcgtcgcaagagagagggggactgatcaggacttctcagttcatcttctcaccatgaggcctccctgctcagctccgtggggctgctaatgctcgtggactacctaggactaccgaggtagggatattattgagtatacgaacccagtacctccctacttctcttctcgtcctaccctcccgtggaccacggcccgccctaccacttcctcctagacctaaggttacctaggtaccaacggtacgtccgttcggtcgactaaggttaggttagaaggttaagggaaaacctacctttaagtacgttacggtttaaccgtacggttacccttagaacgtaacggtaaacgtaccggacgggacccgaccggtacccccttaacccggacgttaaccccgtttccggttaaggtttaaactttttaagtaaaccggtttaaaccggttttaaccgttaaaccgggttttcggttttttaaggggttttcggaaacggttttaccggacccgtaaagggtaccgtacggtccgtttaacggagggttaccggacgggtaccgggtcgggtacggtaacgggaacgtacggttaacgtaaccctaaggtaacgtaacggtaaacgtccggtacgggaccggggtggtaacgggtcggtaggaacggttgttacgggttagtaactttgtttaacttagttcgtacgtaacgttagttaaaccgttagtttaacgtcgtttcgttaccgtttacggtttaaccgttacccgggggttactaaccggggttcctaccggggttaacacgggttaaccgaagttaaacccggg

SEQ ID NO: 105680 - DNA, 696 bp, Homo sapiens
  misc_feature: GYAE6OF02FJ040.29.71.G05.1.454.CMB.1.raw
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagatagagtactcacgaccggtgctcgatttagtgtcgtcgcaagagagaggggggtcaggctggaactgaggagcaggtgggggcacttctccctctaacactctcccctgttgaagctctttgtggacgggcgagcctcaggccctgatggggtgacttcgcaggcgtagactttgtgtttctcgtagtctgtctttgctcagcgtnagggtgntgctggacggnttggtaggtntcgtcgttccttgactaatgtctcgnggtatccgtggntcctaggtggagtatattgatactacgaccctagacctcctactcctaccttcctacgttccccgtacctaccccgttgggaaccgtaccgggccccgtaccccgtacctacttacccgtccgtacgaacctaaacggttcctaacggtaaccgaacgtccggtaccccgtggtactccgtaagttaacgtaggtaagtaacgggaaactacgttaacttagtaccgtacgttacggtacgtacgacgtaacgtaacgttcgaccggtaccgaccgtacccgtacccgaccggtacccgttcgttacgttaacgtttagttacgtttaaaccgttacgtaacgtttacgtttaggttacggtacgtacgacgtacgacgacgtactcgtagggtccgacggtcggtacggtggtaacgg

SEQ ID NO: 105681 - DNA, 673 bp, Homo sapiens
  misc_feature: GYAE6OF02GHA5V.29.71.G05.1.454.CMB.1.raw
  modified_base (253)..(253): a, c, t, g, unknown or other
  misc_feature (253)..(253): n is a, c, g, or t
  modified_base (288)..(288): a, c, t, g, unknown or other
  misc_feature (288)..(288): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
tcagatagagtactcacgaccggtgctcgatttagtgtcgtcgcaagagagagggggtgatcaggacttctcagttcatcttctcaccatgagctccctgctcagctccgtggggctgctaatgctctggatacctggatccagtggagattatggagatcgacccagtactcgactctctctgtaccgtcctacccgtgacacgcccggcctccgatcctctcgactaagtctagctagacgtcttcggtanactagtacgtagtaacttaggaaagtaccttaaancgttagtaccgtacggtactggtaccaaggtacgtacaacggtacccagtccctacgaccgtactctaggtaacttgagtaacttcagttcgtttaagttcgntacgccanacgtacgcagtggnggacgnggacggacgaaggacgtatacgttacaacgtacgtaacgaacgcggtaacggtccggggtaaggtcggacggttagggtaacgtagttcgggtaggttaccctaggttttagttacttcgggaacttaggtacgtacgtttaacgtttacgaacggtttcgttaacggtttaaccgttacggttaaccggtaccggaaccgggttaaccttaacgggtaccgtaaaccggtacgtaacggtaaccgtaaaccgg

SEQ ID NO: 105682 - DNA, 747 bp, Homo sapiens
  misc_feature: GYAE6OF02FM2SH.29.71.G05.1.454.CMB.1.raw
  modified_base (146)..(146): a, c, t, g, unknown or other
  misc_feature (146)..(146): n is a, c, g, or t
tcagatagagtactcacgaccggtgctcgatttagtgtcgtcgcaagagagaggggtgatcaggactctcagttcatcttctcaccatgaggctccctgctcagctcctggggctgctaatgctctgatacctggatccagtgagnattgagatgacccagactccactctctctgtccgtccacccctggacagcccccgggctacccagttccctccgtacgctaagttcctacggttcccaaggtacgtcccgttccgtcgaccgattaacgtaggattagggaaacgtaccccgtaattaactgttaacctcgggtaacctcgtaccagtaaacggtacaacggtccaactcccgtaccacggtacctccgtagtaactttacgtgtaacgtttacctaacgttcgtaacggtttttggaagttacggcccgaaagtaccaggggtactccgtagtacggaccgaacgtcgggtacgtacgggaacgtacgtaaccgtttccgaaactacgtaacgaaaactccgaacggtacccggggttaagggtaccggtcgtagtacgggtagttaccggtagggtaccgtttaagttttaaccgtttaagttaccgtaaccgtagtacggttaaccttaaacggtttactacgtaccgttacggtttaaccgtaccgttttaccggaccggtaaccgggaacccgttacgtaccggttacgtaaccggtacctttaacggaaaacccg

SEQ ID NO: 105683 - DNA, 707 bp, Homo sapiens
  misc_feature: GYAE6OF02ITBVR.29.71.G05.1.454.CMB.1.raw
  modified_base (230)..(230): a, c, t, g, unknown or other
  misc_feature (230)..(230): n is a, c, g, or t
  modified_base (450)..(450): a, c, t, g, unknown or other
  misc_feature (450)..(450): n is a, c, g, or t
  modified_base (503)..(503): a, c, t, g, unknown or other
  misc_feature (503)..(503): n is a, c, g, or t
tcagatagagtactcacgaccggtgctcgatttagtgtcgtcgcaagagagagggggactgatcaggacttctcagttcatcttctcaccatgaggctccctgctcagctccgtggggctgctaatgctctggatactggactccgaggtggagtatattgagtatcgacccagacctccacttctctcttcgtccgtccaccccgtggacgaccggcccggtcctaccncttcctctacgcctaagtctacgtacacggctccgtcgtgactagttaggtagagtaaggaaatactaatatacgttacgttacggtacctagacgtaggtaacgtaccgaacggcctaccgccccgtacaaccgtacctacgttagttaatttacgtagtttaaccgttaccgtaagtttacgtttacgttttggacgtcgacgacgtacgtacggtcngtaggcgacgtcgggtcggtacgacgggtaactacgttatacactaacgtaanaacgtcgaacggggtcgggagtcggagtacggtagtacggttgttagtaacgtttagtttcgttaacgttggtaagttacgttaacgttaaagtttaccggttaacgtacgtttacgtttacggtttaaccttaccgggtttaccggacccggttaacgggttaaccttaccgtaccggttaacgtaccgttaacgtaaaccgg

SEQ ID NO: 105684 - DNA, 963 bp, Homo sapiens
  misc_feature: GYAE6OF02JVIZO.29.71.G05.1.454.CMB.1.raw
  modified_base (103)..(103): a, c, t, g, unknown or other
  misc_feature (103)..(103): n is a, c, g, or t
tcagatagagtactcacgaccggtgctcgatttagtgtcgtcgcaagagagagggggtgatcagacttctcagttcatcttctcaccatgaggctccctgctnacgctccgtggggctgactaatcgctcgtggtactaccgtacggactccgtaggtaggagtattagtttaggagtactaccggacccaacgtacctacccaccttcctccttccgtcgtcccgtaccaccccgtagaccgaccgtcccggcctccgtctcctcctacgactacgtacgtacgacgtacgaacctccgtacgtacgtatacgtagttaggaagtaacggtaacttaacgtaattacggttacgttaacggttccggtaccgtacgaacgtaagtaaccgcggtaaccggacccgtccggtacccctaaccgtaacccgtacgttaccgtaagtttaacggtttacgttaacgtttacggttaaccgtaacgttttacgggtttacgtttacggaccgttacggaccggtaaactaaccgggttacgttaccgacgggtttaacgggtggtaccgggtaacggggtacccggggtaaccgggtaaaggtaccggtaaagtttacccggttaaaacgtaaaacccgttaacgtaaaaccgggttaaaccgtaccggggtaaacccggggttacccgggggtacgggttaacgggtacggttaaccgggtaagggttttacggttaaggggttaaccgtttaaagtttaacgggtttttaaacttacgtttaccggtaacttaaacggttaaacgtttaacgggttaacgttaaacggttccgttaaaccggttttcggtttaacccggttttaccggtttaccccgggggttaacgttaaccccgggtacgtttaacccggggaaccgttttaaccggaaacccggtttaaccggttaaaccgttaaaccggg

SEQ ID NO: 105685 - DNA, 733 bp, Homo sapiens
  misc_feature: GYAE6OF02JO1N3.29.71.G05.1.454.CMB.1.raw
  modified_base (166)..(166): a, c, t, g, unknown or other
  misc_feature (166)..(166): n is a, c, g, or t
  modified_base (231)..(231): a, c, t, g, unknown or other
  misc_feature (231)..(231): n is a, c, g, or t
  modified_base (312)..(312): a, c, t, g, unknown or other
  misc_feature (312)..(312): n is a, c, g, or t
tcagatagagtactcacgaccggtgctcgatttagtgtcgtcgcaagagagagggggactgatcaggacttctcagttcatcttctcaccatgaggctcccgtgctcagctccgtgggctgctaatgctcgtggatacctggactccgagtggagatagttgagtntcgacccagacctcactctctctcgtccgtccacccgttggacacggccgtccctaccacttccnccgtacgctaacgtctagtcagacgccgttgtgactagtagtgtagtacggaactacgtattagtgtaacgtacggttacngtacgacgagtaccgacggcctaccgaccctaccgaccgtacctccgttaagttatttacgtaacggtttaaccgtttaccggaaactttcggttttaagggtttccgaaggttaccggaccgtaaggtccgacggtacccttgggtaaggttccggacgggtaccgggtacggggtcccgtaaaggggtactacggttaccttaccgaaaccgtaacgtaaagtaaccgttaaccggagggttacgggcggtagtcggtagggacgtttggtacggttaccgtatttaacttacgttaagtcgtacgtaggtacgttaaacccgttagtttaccaggtttccgttacgtttaccgttacgggtaccggaccgggttaacggtacccctaggttacccgtaaggtaacgtagtaaacccgg

SEQ ID NO: 105686 - DNA, 831 bp, Homo sapiens
  misc_feature: GYAE6OF02FKGEP.29.71.G05.1.454.CMB.1.raw
  modified_base (332)..(332): a, c, t, g, unknown or other
  misc_feature (332)..(332): n is a, c, g, or t
tcagatagagtactcacgaccggtgctcgatttagtgtcgtcgcaagagagagggggactgatcaggacttctcagttcatcttctcaccatgaggcctccctgctcagctccgtggggctgctaatgctctggacttaccgtggactccgagtggagtattattgagatcgacccagacctccacttctctctcgtccgtccacccctggacgaccggcccggccctccagttcctcctgaactacgttcgtaacgtcgagtcgtccttcgtcgactacgtaggtcgtaagtaacggaaactacttagtacgttaggtaccgttcggtacncggacgtagacgtaccgacgccgtaccgccgtaccgaaccgtccttacgtagttactttaagtacggttaacgttaccgtacggtttacgttttaaggttttcgggacgttacgaacgtaacggtaccgtacggtctacggtaacgggtccggacggttaaccgggccggggttaacggaacggtaccggtttaagttacgtttaacccggaacttaacggtaaagtaaaaccgttcgggtacccgggggtaaccggggttaaggcgggtttaacgtacgggggttaaggttacggttacgggtttaccgtttaacgttttaagttttaaccggtttacgtaacgttacgttaaccgtagttaaaaccctttaacggggtttctaaccgggtttacttttacccgttaccggttttaaccgggtttacccggaaccgggtttaaccggtacccgttaaaccggttacccggttaaccggaaccttaacccggtaaacgg

SEQ ID NO: 105687 - DNA, 763 bp, Homo sapiens
  misc_feature: GYAE6OF02FP64Z.29.71.G05.1.454.CMB.1.raw
  modified_base (219)..(219): a, c, t, g, unknown or other
  misc_feature (219)..(219): n is a, c, g, or t
tcagatagagtactcacgaccggtgctcgatttagtgtcgtcgcaagagagagggggtgatcaggacttctcagttcatcttctcaccatgaggctccctgctcagctccgtggggctgactaagtgctcgtaggactaccgtggactccgaggtggatattagtagagtatcgacccagtacctcctacttctctcgtcgtccgtccacccgtggacncggcccgtcctacctactcctcctcgacgtaacgttcgtacgtacgagaccgtccgttgtagctaagttagagtaagtaacggaaactacttaagtcgttagtaccgtacggtaccgtagaacaaggtagcccgaggacctccgtacccgtacccgacgtacttacgttagtttaacttacggtacgttaacctttaaccggtaagttttacgttttagggttacgggacggttaccggtaacgtaacgggtaaggtaccggttacggaacggttagggccggtaacgggttaacggggttaccgggtacgggtaaacggtaaccggttagttaaccgttaaccgtaaacgtaaaaccgttaagggaaacgtcggggtacgggtaaccggggtaggtacgggtacggtaaggtaggttgtttacgggtacgtttattaacgttttattacggtactaggttacgtagttaacgttaagttcgtagttacttcgttacggttacgttcgggacgttacgacttcgtacgacactacgtacgtacg

SEQ ID NO: 105688 - DNA, 703 bp, Homo sapiens
  misc_feature: GYAE6OF02GSESY.29.71.G05.1.454.CMB.1.raw
  modified_base (231)..(231): a, c, t, g, unknown or other
  misc_feature (231)..(231): n is a, c, g, or t
tcagatagagtactcacgaccggtgctcgatttagtgtcgtcgcaagagagagggggtgatcaggacttctcagttcatcttctcaccatgaggctccctgctcagctcctggggctgctaatgctctggatacctggatccagtggagatattgagatgacccagactccactctctctgtccgtcacccctggacacgccggcctccatctcctgcaagtctagtcagngcctgtgctagtagtgatggaaacgtcctaatagttgtacttcggtaccctggacaagaacgtcgagggacccagcccctaccgaacgccttcctaggtactttagtcgtaacgtttccaagttcgtttaagtttggatcgcaagacgacgcttacaggtcgctacggcgggtacgaagggtacagtacttcaactataggaaactcggacgggtccgggtgggacgcgttacggaaggtacgtttggttacggtactttaagttttaaagtttgttagtaccgttaaggttacctaaaccgggtttaaaatttcccggaggttttacccgttttaaccgggttttaaccctttttacccggggggtttttaccggggaacccccggtttaacggggggtttaacccccctacggttttaaccccgggttaacgggtaaaccttacccgggtttaaactaaaaccccggggg

SEQ ID NO: 105689 - DNA, 695 bp, Homo sapiens
  misc_feature: GYAE6OF02F5PRO.29.71.G05.1.454.CMB.1.raw
  modified_base (346)..(346): a, c, t, g, unknown or other
  misc_feature (346)..(346): n is a, c, g, or t
tcagatagagtactcacgaccggtgctcgatttagtgtcgtcgcaagagagagggggtgatcaggacttctcagttcatcttctcaccatgaggctccctgctcagctccgtggggctgctaatgctctgactacctggatccagtggagatatgagatcgacccagacctccactctctctacgtcccgtcctacccgtggacacggcccggtcctacctactcctcctcgacgtaacgttctaggtaccgacgtacgtccgtcgttcgactaagttaggtagagtaaggaaaacgtacttaatagtacgttacgtcgtaccgtgtacgagtacgtcgacgaccncgtccctaccgactacctctgtaatttgagttacgttcagttctttagttagactcgacacgactcggtcgtacgagtgacgcgggtcggtacggaggtactagtacttaccaagtaacctaagtaacgtacggacgggtaccggggtaggccgtagtacgggtaaggttaggtttagggttaacgttagttttaacgttttaagttacggtttaccgaagttacggttaacaaacgtttaacggttttacacgtttacgtttaccgtttacgtttaccgggtttaccgggaacggttaccgggtaccgttcttaacccgggataacgtaccgttaaaccggtaaccgg

SEQ ID NO: 105690 - DNA, 733 bp, Homo sapiens
  misc_feature: GYAE6OF02JMX3J.29.71.G05.1.454.CMB.1.raw
  modified_base (169)..(169): a, c, t, g, unknown or other
  misc_feature (169)..(169): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (257)..(257): a, c, t, g, unknown or other
  misc_feature (257)..(257): n is a, c, g, or t
tcagatagagtactcacgaccggtgctcgatttagtgtcgtcgcaagagagaggggggactgatcaggacttctcagttcatcttctcaccatgaggcctccctgctcagtcctccgtggggctgacttaatcgctctggatacctggactccagtggagattatgagntcgaccagacctccacgtctctcgtcgtcctcacccgtgacncgccgcncactctccgtgactacgttcgtactcagcgtcgtcacgntatggtacagtacggaaactaccgtatgttacgtagttcggtaccgtcgtacgaacggtacgtacgacgccgactacccgtacgaaccgtaccttacggttacttaagttacgttacgttaacggttaccttaaggtttacggtttagtttagggtacgacggacccgtaagtaccggacgtcgtaccggtttaggaccgggtacggacgggtcggtaaccgggaacggtaaccgtacggttacttaacccgactaaccgtaaggtaaaccgtacgggaccgggtacggggtacggtacggtagggtaacggtacggtacgggttacggttacgtttacgtttactttaagttacgttcgtaggttaacgtacgtaacggttacgttaacggtgttaacgtttaccgtttacggtaccgtttaccggtacggtaccggttaccgtacggttcgtacggtaacctaccggtaaacgg

SEQ ID NO: 105691 - DNA, 645 bp, Homo sapiens
  misc_feature: GYAE6OF01DF78Y.41.21.B10.1.454.CMB.1.raw
tcagtctatactatcacgaccggtgctcgatttagtgtcgtcgcaagagaggaggggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacgttgccgggccagtcaggttattaatagttggtgctggtatcagcaagaaacgagggaaacacccctaaactccgtagatactaagtaacggcgttacttacgtttagagtaggttcgggttcccttacgtaaggttcagtggcgaggtggtatcgtagggactaggtacgttacccacctacaccgtacgtcggacacgtcctagaccacgcctagaagataacgtacgacctaactttattactacgtacaactaataacttaactactttaagtcgagggtactacgttacggaccgtaacgggaccgtaaagggtaacgtaaaacttaaacggtaacgtaggtacggtactacggtacccaaccgtaacgttaccgtttacggtttaccctttaccgttaaccgttcccctttacccccggtaacc

SEQ ID NO: 105692 - DNA, 722 bp, Homo sapiens
  misc_feature: GYAE6OF01C5S47.41.21.B10.1.454.CMB.1.raw
  modified_base (204)..(204): a, c, t, g, unknown or other
  misc_feature (204)..(204): n is a, c, g, or t
tcagtctatactatcacgaccggtgctcgatttagtgtcgtcgcaagagaggaggggggagtcagacccagtcaggacacagcatggacatgagggtccccgctcagctcctggggctcctgctgctctggctcccgaggtgccaaatgtgacatccagatcgacccagtcctccttccacctgtctgcattcgtaggtagganacgagacgtccaccatcacgttcggccgggctagtcgtaggtttaatttaattagtttgggttcggtccgttaggtatcgagacgaacgaaaccgaagggtaaccaccccttaaacgtccctagacttacgtaagtaacggtccgttactttagtttaggaggtacggttcgggttacccttacggtaaggttcgaggtggacgtagggtggagtcggtagggacacggtacgttacccaccctcgaaccgtagttccggacgaccgtccgtcgacgaccgtacctagggtaagtaacttaccgtaaccggttaacttaacgttttaaccgttacttaccgtaaccaaacttaaacttaaaccgttaacctacgtttaacgtacggacgggtaccttacggtaccggaacgtaacgggaacgtaaggtaacggtaaacgtaaacgagttacggtacggtaccaggtacctacctacgttacgttaccgttacgtctaacccgtttcccgtacccgtac

SEQ ID NO: 105693 - DNA, 792 bp, Homo sapiens
  misc_feature: GYAE6OF01B34X4.41.21.B10.1.454.CMB.1.raw
  modified_base (104)..(104): a, c, t, g, unknown or other
  misc_feature (104)..(104): n is a, c, g, or t
  modified_base (158)..(158): a, c, t, g, unknown or other
  misc_feature (158)..(158): n is a, c, g, or t
tcagtctatactatcacgaccggtgctcgatttagtgtcgtcgcaagagaggagggggggagtcagacccagtcaggacacagcatggacatgacgggtccccnctcagctccgtggggctcctgctgctctcggcctccgaggtcgacaaatggtanacactccgagactacgacctacgtcctcccttaccctacccgtgtcgtcgactacttcgtaggtaaggaagacgagactaccaccgacttacgtaccgtccggcccgggacctaaggtacgttaaggttttaattaacgttaggttcgggttcggtccgttagtactacgagaaccggaaaccggaaaccggaaccggaaaccgtacccctaaacgtaccgtagtaactacgtaacgaacggttaccgttacttacggtagggaacggttaccgggttaccgggttaccttagggtaacgtcggacggtcggtagtacggtagtacgtcggtacggaagtacgtactcctacccgtacgacgacggtcgactcgtacgtgacgacgtacgtaggaataaccgtacgtactaacttaacgtacttaacgtaacgtaactaacttaaacttaacttaacgtaactttaacggacgggtaccgtaacgtaccgggttaccggtaaaccggtaaccgggtaacggtaaacgggttaaaaggttaaaccggtaaacggtacgttacggggtacggtaacctacggaccttccggtatttacggtaccttacctaccgttaccctcccgtaccggtaacc

SEQ ID NO: 105694 - DNA, 782 bp, Homo sapiens
  misc_feature: GYAE6OF01DHXDE.41.21.B10.1.454.CMB.1.raw
  modified_base (734)..(734): a, c, t, g, unknown or other
  misc_feature (734)..(734): n is a, c, g, or t
tcagtctatactatcacgaccggtgctcgatttagtgtcgtcgcaagagaggaggggggagtcagacccagtcaggacacagcatggacatgacgggtccccgctcagctccgtggggctcctgctgctcgtcggcctcccgaggtcgacctaaagtgtagacactccagactcgaccctagtcctccctccacctgtctcgctagtcgtaggtaggacgacgagactccaacctatctacgtccggaccggtcctagtacgtaagtttaacttaagttagttcgggtacgttaccgtaggtactacgaacgtaaccgaaacggaaaccggaacgggtaaaccctaccccttaaaacgtcccgtaagtaacttaacgtaacggtaccggtacctttaacgttaacgttaaggacggttacgggttccgggttaccttaacggaaggttccgagggtacggacggtagggtacggtacgtacggtacgggaacgtacggttaccgttacccaccgtaccgaactacgggtcccgaccgacggtacccgtacgacgtaccggtacgtaagggtaactattaccgtacgtaacttaacgtttgtacctaagaaacctaaattaaacttaacgtaaccttaacgttcgaacggtaccgtaacgttacggtaaccgggaacggtaacgggtaacgaaagggttaacgaaacgttaaccggtagcggttacgacgtaacnctaacctagttaccgtacgtttccctaactccccgtcgttaccctaag

SEQ ID NO: 105695 - DNA, 518 bp, Homo sapiens
  misc_feature: GYAE6OF02G2GQP.41.21.B10.1.454.CMB.1.raw
  modified_base (417)..(417): a, c, t, g, unknown or other
  misc_feature (417)..(417): n is a, c, g, or t
  modified_base (498)..(498): a, c, t, g, unknown or other
  misc_feature (498)..(498): n is a, c, g, or t
tcagtctatactatcacgaccggtgctcgatttagtgtcgtcgcaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgacattggtggttataactttgtctcctggtaccaacaccacccaggcaaagcccccaaattcatcatttatgatgtcagtaagcggccctcagggtccctgatcgcttctctggctccaagtctggcaacacggcctccctgaccgtctctgggctccaggctgagatgaggctgactatttctgctcctnatatgcaggcgacgtaggttttatgttcttcggactgggaccaggtccacgtcctacgtcacgtcccaaggcccaaccccnctcgtcactctcgttacccc

SEQ ID NO: 105696 - DNA, 984 bp, Homo sapiens
  misc_feature: GYAE6OF02IBU3S.41.21.B10.1.454.CMB.1.raw
tcagtctatactatcacgaccggtgctcgatttagtgtcgtcgcaagagaggaggggggagtcagacccagtcaggacacagcatggacatgagggtccccgctcagctccgtggggctcctgctgctctggctcccaggtcgaccaaagtgtgacatccagatcgacccagtcctccttcccacctgtctgctattcgtaggtaggagaactacgagtcaacctatacctacgttcggacccggggtaccctaggttcgtaagggtttaactttaaacgttaaggtttgggttcggtcgttaggtactacgagtacgaaacgtaaaaccggaacggtaaaccgtaaccccctaaaaccttcgtacgtaactacgttaaacgtaaccggtcgtttaacgtttaaccgttaaggtaacggtacgggttaccggggttaccctttaacggtaacggttacgtacggtggtaccgtagggtaggtagtacggtagggaacgtagtaacgttcctaaccctaccgaaccgtacgtaccggacgtaccgtaccgtcggtacccgaaacggttcgtaaaccggtaaaagttaacgttaaacccggttaacccgtaaaccgttttaaaaccgttttacgttaaacccgttttacgtaaaaacctaaaaaccgtttaaacgtttaaaaccgttaaaacccgtttaacgtttaaaccgggttaaccgggtaaccggggttaacgtttaacccgggttaacccgggtaaaacccgggtaaaaccgggggttaaaaacccgggttaaaaacgggggtttaaaaacccggtaaaaaaccgggttttaaaaccggtaaaaccgggttttaacgggttaacccgggttaacccgttaaaccgtacccccgggttaaaacctccggtttaaccgtttaccggttttaaccccttcccgttttaaccccggttttaccccccgtaccccgtttaaccccg

SEQ ID NO: 105697 - DNA, 655 bp, Homo sapiens
  misc_feature: GYAE6OF02JB30H.41.21.B10.1.454.CMB.1.raw
  modified_base (379)..(379): a, c, t, g, unknown or other
  misc_feature (379)..(379): n is a, c, g, or t
tcagtctatactatcacgaccggtgctcgatttagtgtcgtcgcaagagaggagggggggagtcagacccagtcaggacacagcatggacatgagggtccccgctcagctcctggggctcctgctgctctggctccaggtgccaaatgtgacatccagatgacccagtctcctccaccctgtctgcatctgtaggagacagagtcaccatcacttggccggcagtcaggtataatagttggtgctgtatgagcaagaaccaggaacaccctaactcctgactctaagtacgcgtctacgttgagtagggtcgggtaccttacgtaaggttcgagtggactaggtgtatcgtagggactagtacgtccaccctcgaaccngtaccggcacgcctacgccgacgccgtaagaacgtactacgtaccgtaccttaaagttactttaccgtagtaaaccaaacgtaattaacttaaccgtactttaagtacgggaacggtcttaaccggttaccgggaacgtaaccggggtaaactaagggggttaaaccggaaaaggtttaacccgaacgttgggggtaacccggttactaacgggtaaccctaacggttcttacggtacggttttaccctaggttaacccttcccgttaccccgtag

SEQ ID NO: 105698 - DNA, 436 bp, Homo sapiens
  misc_feature: GYAE6OF01EVHT6.11.70.G04.1.454.CMB.1.raw
  modified_base (432)..(436): a, c, t, g, unknown or other
  misc_feature (432)..(436): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcgctgagcgggctggcaaggcgcatagnnnnn

SEQ ID NO: 105699 - DNA, 441 bp, Homo sapiens
  misc_feature: GYAE6OF01AVN4T.11.70.G04.1.454.CMB.1.raw
  modified_base (437)..(441): a, c, t, g, unknown or other
  misc_feature (437)..(441): n is a, c, g, or t
tcagcgagagataccacgaccggtgctcgatttagtgtagtgtgaagggaaagggttgtaattggtgtttccagtgatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggacacagcggccctgggctgcctggtcaaggactacttccgtatctctcgctgagcgggctgggcaaggcgcatagnnnnn

SEQ ID NO: 105700 - DNA, 436 bp, Homo sapiens
  misc_feature: GYAE6OF01B46DN.11.70.G04.1.454.CMB.1.raw
  modified_base (434)..(436): a, c, t, g, unknown or other
  misc_feature (434)..(436): n is a, c, g, or t
tcagcgagagataccacgaccggtgctcgatttagtgtagtgtgaagggaaagggttgtaattggtgtttccagtgatatcgataccactggaaacaccaattacaacccctccctcaagagtcgagtcaccatatccctgacgtccaagagtcagctctccctggagctgacttctgtgaccgccacagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggccctgggctgcctggtcaaggctactccgtatctctcgctgagcgggctggcaaggcgcatagnnn

SEQ ID NO: 105701 - DNA, 450 bp, Homo sapiens
  misc_feature: GYAE6OF01A6FU4.11.70.G04.1.454.CMB.1.raw
  modified_base (439)..(450): a, c, t, g, unknown or other
  misc_feature (439)..(450): n is a, c, g, or t
tcagcgagagataccacgaccggtgctcgatttagtgtagtgtgaagggaaaggggttgtaattggtgtttccagtgatatcgataccactggaaacaccaattacaacccctccctcaagagtccgagtcaccatatccctgacgtccaagagtcagctctccctggagctgacttctgtgaccgccgcagacacggccgtgtattactgtgcgcgacgtcgtcccttgaaagtattgttagggacctccactacggtatggacgtctggggccaagggaccacggtcaccgtctcctcagcctccaccaagggcccatcggtcttccccctggccaccctcctccaagagcacctctgggggcacagccggcctgggctgcctggtcaaggactacttccgtatctctcgctgagcgggctggcaaggcgacatagnnnnnnnnnnnn

SEQ ID NO: 105702 - DNA, 445 bp, Homo sapiens
  misc_feature: GYAE6OF01DBDI2.11.70.G04.1.454.CMB.1.raw
  modified_base (433)..(445): a, c, t, g, unknown or other
  misc_feature (433)..(445): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtccttcccctggcaccctcctccaagacgcacctcgtgggggcacagcggccctgggctgcctggtcaaggactactccgtatctctcgctgagcgggctggcaaggcgcatagnnnnnnnnnnnnn

SEQ ID NO: 105703 - DNA, 918 bp, Homo sapiens
  misc_feature: GYAE6OF01E515J.11.70.G04.1.454.CMB.1.raw
  modified_base (360)..(360): a, c, t, g, unknown or other
  misc_feature (360)..(360): n is a, c, g, or t
tcagcgagagataccacgaccggtgctcgatttagtgtagtgtgaagggaaaggggttgtaattggtgtttccagtggtatcgatatgaccaatccactccagtccctcgtccctcagctcgcactgtctctggcggcttctactcaacacgtggttacttttactactggacctggtactccggcacggcccggccggggaagggtactgggagtggtacttggtacagtattacgactacctacacggtaaaaccacctaacttaaccaccccctccctacaacgtaggtcgacgtaccaactactactccctggtaccgtaccgaacgaacgtcgacgccttcctcccgtaggtacncgtacggtaccttccttggtccgacccggtccgacgaccggaacctacgggtccgtagttacgttaactcggttcgccggtaccgtaccggttcccgttaacccgttaggtaaaacggtaagttttacggggttaacgggtacccttaccggtaaaccggttaacggtaccggttagggtaccccggttagggtaccgggggtaccccgtaaacgggggtaaccccgtaccccgggttaccgtaacccggttcccgttacccgttccgtaaccgtcccccgtacccgaaacccgaaaccgggtcccccgtaagggttcccccgttaccccgtttcccccgaccgggttacccccaaccccggttaccccgtttacccgggaaaacgttcccggaccttacccgggttaccgggtaccgggacgttaaccccgggaccggtacccccggggtacccggtccggggttacccgccgggtttacccgtacccggggttaacgtaacccgggtaacccttttacgggtaaccccgtttccttcccgtccccggtttaccggg

SEQ ID NO: 105704 - DNA, 450 bp, Homo sapiens
  misc_feature: GYAE6OF01AQO2Y.11.70.G04.1.454.CMB.1.raw
  modified_base (430)..(430): a, c, t, g, unknown or other
  misc_feature (430)..(430): n is a, c, g, or t
  modified_base (437)..(450): a, c, t, g, unknown or other
  misc_feature (437)..(450): n is a, c, g, or t
tcagcgagagataccacgaccggtgctcgatttagtgtagtgtgaagggaaagggacgtggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggccaccctcctccaagacgcacctctgggggcacagcggccctgggctgcctggtcaaggctacttccgtatctctcgctgagcgggctgggcaagggcncatacgnnnnnnnnnnnnnn

SEQ ID NO: 105705 - DNA, 434 bp, Homo sapiens
  misc_feature: GYAE6OF02FXORL.11.70.G04.1.454.CMB.1.raw
  modified_base (431)..(434): a, c, t, g, unknown or other
  misc_feature (431)..(434): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnnnn

SEQ ID NO: 105706 - DNA, 436 bp, Homo sapiens
  misc_feature: GYAE6OF02I4MIZ.11.70.G04.1.454.CMB.1.raw
  modified_base (342)..(342): a, c, t, g, unknown or other
  misc_feature (342)..(342): n is a, c, g, or t
  modified_base (426)..(436): a, c, t, g, unknown or other
  misc_feature (426)..(436): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtccttgaaagtattgttaggacctcactacggtatggacgtctggggccaagggaccacggtcaccgtcgtcctcagcctccaccaagggcccatcggtcttcccctggcaccctcctccaacgngcacctctggggcacagcggcctgggctgcctggtcaaggactactccgtatctctcgctgagcgggctggcaaggcgcatagnnnnnnnnnnn

SEQ ID NO: 105707 - DNA, 437 bp, Homo sapiens
  misc_feature: GYAE6OF02I1JCQ.11.70.G04.1.454.CMB.1.raw
  modified_base (429)..(437): a, c, t, g, unknown or other
  misc_feature (429)..(437): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaaggctactccgtatctctcgctgagcgggctggcaaggcgcatagnnnnnnnnn

SEQ ID NO: 105708 - DNA, 443 bp, Homo sapiens
  misc_feature: GYAE6OF02G89WA.11.70.G04.1.454.CMB.1.raw
  modified_base (436)..(443): a, c, t, g, unknown or other
  misc_feature (436)..(443): n is a, c, g, or t
tcagcgagagataccacgaccggtgctcgatttagtgtagtgtgaagggaaaggggttgtaattggtgtttccagtgatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctcaccaagggcccatcggtcttccccctggccaccctcctccaagagcacctctgggggcacagcggccctgggctgcctggtcaaggctacttccgtatctctcgctgagcgggctggcaaggcgcatagnnnnnnnn

SEQ ID NO: 105709 - DNA, 442 bp, Homo sapiens
  misc_feature: GYAE6OF02IWX9J.11.70.G04.1.454.CMB.1.raw
  modified_base (433)..(442): a, c, t, g, unknown or other
  misc_feature (433)..(442): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgtaggacctccactacggtatggacgtctggggccaagggaccacggtcaccgtctcctcagccctccaccaagggcccatcggtcttccccctggcaccctcctccaagagcacctctcgggggcacagccggccctgggctgcctggtcaaggactactcgtatctctcgctgagcgggctggcgaaggcgcatggcnnnnnnnnnn

SEQ ID NO: 105710 - DNA, 442 bp, Homo sapiens
  misc_feature: GYAE6OF02G1L16.11.70.G04.1.454.CMB.1.raw
  modified_base (436)..(442): a, c, t, g, unknown or other
  misc_feature (436)..(442): n is a, c, g, or t
tcagcgagagataccacgaccggtgctcgatttagtgtagtgtgaagggaaaggggttgtaattggtgtttccagtgatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttcccctggcaccctcctccaagagcacctctcgggggcacagcggccctgggctgcctggtcaaggactactccgtactctctcgctgagcgggctggcaggcgcatagnnnnnnn

SEQ ID NO: 105711 - DNA, 569 bp, Homo sapiens
  misc_feature: GYAE6OF02JTEGJ.11.70.G04.1.454.CMB.1.raw
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagcgagagataccacgaccggtgctcgatttagtgtagtgtgaagggaaagggttgtaattggtgtttccagtgatatcgataccactggaaacaccaattacaacccctcctcaacgagtcgagtcaccatatccctgacgtccaagagtcagctctccctggagctggacttctgtgaccgccgcagacacggccgtgtacttactgtgcgcgacgtcgtccttagaaagtattgttaggacctcacgtacggtatggacgtcgtcgggaccgaacggaccaacggtcaccgtcgtcctcacgcctaccaccgaacggcccagtcgtccgtcccctcggccacccgtcctaccgaacgtcgccgtacctcgtcggggccacgacgccggaccgtgggcctacggtcctcggtcgaaacgtcgttacgtcccgttaactccgtcgtcgcgtcgcggtaccggctcgggacgacggtcgacgacgtagcngtacngtgcngctacncgngcngcgcgngcgcgtcgngcncgcgctacgcgcncgncgtcncgncgcgngactcntn

SEQ ID NO: 105712 - DNA, 726 bp, Homo sapiens
  misc_feature: GYAE6OF02IAIU8.11.70.G04.1.454.CMB.1.raw
  modified_base (242)..(242): a, c, t, g, unknown or other
  misc_feature (242)..(242): n is a, c, g, or t
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
tcagcgagagataccacgaccggtgctcgatttagtgtagtgtgaagggaaagggactggagtggattggtcatatcgataccactggaaacaccaattacaacccctcctcaagagtcgagtcaccatatcctgacgtccaagagtcagctctcccgtggagtctagtactctgtgaccgcgcacgacgacggccgtgtatacgtgtgcgcgacgtcgtcctagaagtattagtacggtcncacgtacgtagtcgacgtcgtagggaccaaggtaccgacggtaccgaccgtccgtcctacgacgtccctacccaccgtaacgggcccctaagtccggttcccttaccccgtcggtacccaccccgttcccgtaacgaacggaaccgccctaaccgttccgggtaccggggacctaacgaccggcccggggacccgtacggggtacccttccggtcccggtacggtaaccgtaacggtaacccgtttaccggttacccgtttaacggttcccttcccggttaccgtaccggtaaggggtcccggggtacgggtacccggttaccgggaacccggtaacgggaccccgtcggtaaagttaaccggagaagtcgaacgngtagngagtacgtgacacgtacgacgagagagtacgcgacgcgtacgacgtactctacgtcgtcgactcgtacgtacgtacgtacggtacgtacgacgtacgtcgacg

SEQ ID NO: 105713 - DNA, 260 bp, Homo sapiens
  misc_feature: GYAE6OF01CUBRO.1.63.F08.1.454.CMB.1.raw
  modified_base (259)..(260): a, c, t, g, unknown or other
  misc_feature (259)..(260): n is a, c, g, or t
tcagacgagtgcgtcacgaccggtgctcgatttagcgatcgtatatcgcggggacgcggccaccctgaccatcagcagggccgacgccgggatgaggccgactattattgtcaggtgtgggatcctgataatgatcagcatgtggttttcggcggagggaccaagctgaccgtcgtgggtcagcccaaggctgccccacggtcactctgttcccgccctcctctgtcgagcgtctgagcgggctggcaaggcgcatagnn

SEQ ID NO: 105714 - DNA, 251 bp, Homo sapiens
  misc_feature: GYAE6OF01D8AR2.1.63.F08.1.454.CMB.1.raw
  modified_base (251)..(251): a, c, t, g, unknown or other
  misc_feature (251)..(251): n is a, c, g, or t
tcagacgagtgcgtcacgaccggtgctcgatttagcgatcgtataaagggaaagggacagatttcacactgaaaatcagccgggtggaggctgaggatgttggagtttattactgcatgcaagatttccgagatcctcactttcggcggagggaccagggtggagatcaaacgaactgtggctgcaccatctgtcttcatcttcccgccatctgaacgcactcgtctgagcgggctggcaaggcgcatagn

SEQ ID NO: 105715 - DNA, 261 bp, Homo sapiens
  misc_feature: GYAE6OF01CCT2A.1.63.F08.1.454.CMB.1.raw
  modified_base (258)..(261): a, c, t, g, unknown or other
  misc_feature (258)..(261): n is a, c, g, or t
tcagacgagtgcgtcacgaccggtgctcgatttagcgatcgtatatcgcgggacgcggccaccctgaccatcagcagggccgacgccgggatgaggccgactattattgtcaggtgtgggatcctgataatgatcagcatgtggttttcggcggagggaccaagctgaccgtcgtgggtcagcccaaggctgccccacggtcactctgttcccaccctcctctgtcgagcgtctgagcgggctggcaaggcgcatagnnnn

SEQ ID NO: 105716 - DNA, 263 bp, Homo sapiens
  misc_feature: GYAE6OF01DNWYO.1.63.F08.1.454.CMB.1.raw
  modified_base (255)..(255): a, c, t, g, unknown or other
  misc_feature (255)..(255): n is a, c, g, or t
  modified_base (261)..(263): a, c, t, g, unknown or other
  misc_feature (261)..(263): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcacaccctcctctatgtatactctgagcgggctggcaaggcncatagnnn

SEQ ID NO: 105717 - DNA, 262 bp, Homo sapiens
  misc_feature: GYAE6OF01BT5BC.1.63.F08.1.454.CMB.1.raw
  modified_base (261)..(262): a, c, t, g, unknown or other
  misc_feature (261)..(262): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctccgtgtctgatctgagcgggctggcaaggcgcatagnn

SEQ ID NO: 105718 - DNA, 262 bp, Homo sapiens
  misc_feature: GYAE6OF01ATQ1N.1.63.F08.1.454.CMB.1.raw
  modified_base (259)..(262): a, c, t, g, unknown or other
  misc_feature (259)..(262): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactcgttcccgcctcctccgtgtctgatctgagcgggctggcaaggcgcatagnnnn

SEQ ID NO: 105719 - DNA, 259 bp, Homo sapiens
  misc_feature: GYAE6OF01DSJWE.1.63.F08.1.454.CMB.1.raw
  modified_base (259)..(259): a, c, t, g, unknown or other
  misc_feature (259)..(259): n is a, c, g, or t
tcagacgagtgcgtcacgaccggtgctcgatttagcgatcgtatatcgcgggacgcggccaccctgaccatcagcagggccgacgccgggatgaggccgactattattgtcaggtgtgggatcctgataatgatcagcatgtggttttcggcggagggaccaagctgaccgtcgtgggtcagcccaaggctgccccctcggtcactctgttcccgccctcctctatacgatcgctgagcgggctggcaaggcgcatagn

SEQ ID NO: 105720 - DNA, 263 bp, Homo sapiens
  misc_feature: GYAE6OF01B5XUI.1.63.F08.1.454.CMB.1.raw
  modified_base (261)..(263): a, c, t, g, unknown or other
  misc_feature (261)..(263): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccgccctcctctgtcgagcgtctgagcgggctggcaaggcgcatagnnn

SEQ ID NO: 105721 - DNA, 280 bp, Homo sapiens
  misc_feature: GYAE6OF01EXDUD.1.63.F08.1.454.CMB.1.raw
  modified_base (266)..(280): a, c, t, g, unknown or other
  misc_feature (266)..(280): n is a, c, g, or t
tcagacgagtgcgtcacgaccggtgctcgatttagcgatcgtatatcgcggggacggcggccaccctgaccatcagcagggcccgacgcccggggatgtaggccgactattattgtcaggtgtgggatcctgataatgatcagcatgtggttttcggcggagggaccaagctgaccgtcgtgggtcagcccaaggctgcccccacggtcactctgttccccaccctcctctgtcgagcgtctgagcgggctggcaaggcgcatagnnnnnnnnnnnnnnn

SEQ ID NO: 105722 - DNA, 267 bp, Homo sapiens
  misc_feature: GYAE6OF01C050P.1.63.F08.1.454.CMB.1.raw
  modified_base (259)..(267): a, c, t, g, unknown or other
  misc_feature (259)..(267): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccgcctcctccgtgtctgatctgagcggctggcaaggcgcatagnnnnnnnnn

SEQ ID NO: 105723 - DNA, 262 bp, Homo sapiens
  misc_feature: GYAE6OF01BOCCC.1.63.F08.1.454.CMB.1.raw
  modified_base (260)..(262): a, c, t, g, unknown or other
  misc_feature (260)..(262): n is a, c, g, or t
tcagacgagtgcgtcacgaccggtgctcgatttagcgatcgtatatcgcgggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctctgtcgagcgtctgagcgggctggcaaggcgcatagnnn

SEQ ID NO: 105724 - DNA, 262 bp, Homo sapiens
  misc_feature: GYAE6OF01EAQ8C.1.63.F08.1.454.CMB.1.raw
  modified_base (261)..(262): a, c, t, g, unknown or other
  misc_feature (261)..(262): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctctgtcgagcgtctgagcgggctggcaaggcgcatagnn

SEQ ID NO: 105725 - DNA, 258 bp, Homo sapiens
  misc_feature: GYAE6OF01CHKPV.1.63.F08.1.454.CMB.1.raw
  modified_base (251)..(258): a, c, t, g, unknown or other
  misc_feature (251)..(258): n is a, c, g, or t
tcagacgagtgcgtcacgaccggtgctcgatttagcgatcgtataaagggaaagggacagatttcacactgaaaatcagtcgggtggaggctgaggatgttgggtttattattgcatgcaaagtatacaagttccgtggacgttcggccaagggaccaaggtggaaatcaaacgaactgtggctgcaccatctgtcttcatcttcccacctcctcacgcactcgtctgagcgggctggcaaggcgcatagnnnnnnnn

SEQ ID NO: 105726 - DNA, 268 bp, Homo sapiens
  misc_feature: GYAE6OF01BPO5U.1.63.F08.1.454.CMB.1.raw
  modified_base (257)..(268): a, c, t, g, unknown or other
  misc_feature (257)..(268): n is a, c, g, or t
tcagacgagtgcgtcacgaccggtgctcgatttagcgatcgtatatcggcgggacgcggccaccctgaccatcagcagggccgacgccgggatgaggccgactattattgtcaggtgtgggatcctgataatgatcagcatgtggttttcggcgagggaccaagctgaccgtcgtgggtcagcccaaggctgccccacggtcactctgttcccgccctctctgtcgagcgtctgagcgggctggcaaggcgcatagnnnnnnnnnnnn

SEQ ID NO: 105727 - DNA, 264 bp, Homo sapiens
  misc_feature: GYAE6OF01E3V8B.1.63.F08.1.454.CMB.1.raw
  modified_base (261)..(264): a, c, t, g, unknown or other
  misc_feature (261)..(264): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctctgtcgagcgtctgagcgggctggcaaggcgcatagnnnn

SEQ ID NO: 105728 - DNA, 262 bp, Homo sapiens; identical to SEQ ID NO: 105724
  misc_feature: GYAE6OF01EBSVZ.1.63.F08.1.454.CMB.1.raw
  modified_base (261)..(262): a, c, t, g, unknown or other
  misc_feature (261)..(262): n is a, c, g, or t

SEQ ID NO: 105729 - DNA, 287 bp, Homo sapiens
  misc_feature: GYAE6OF01CP8BS.1.63.F08.1.454.CMB.1.raw
  modified_base (132)..(132): a, c, t, g, unknown or other
  misc_feature (132)..(132): n is a, c, g, or t
  modified_base (262)..(287): a, c, t, g, unknown or other
  misc_feature (262)..(287): n is a, c, g, or t
tcagacgagtgcgtcacgaccggtgctcgatttagcgatcgtataaagggaaagggtacgagatttcacactcgaaaatcaggtcgggtggaggctgaggatgttgggtttagttacttgcatgcaaaggtntacaagttccgtggacgttcggccaagggaccaagggtggaaatacaaacgactgtggcctgcaccatcctgtcttcactcttcccgccctcctcacgcactcgtctgagcggctggcaaggcgcatagnnnnnnnnnnnnnnnnnnnnnnnnnn

SEQ ID NO: 105730 - DNA, 261 bp, Homo sapiens
  misc_feature: GYAE6OF01EQTN7.1.63.F08.1.454.CMB.1.raw
  modified_base (261)..(261): a, c, t, g, unknown or other
  misc_feature (261)..(261): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctccgtgtctgatctgagcgggctggcaaggcgcatagn

SEQ ID NO: 105731 - DNA, 220 bp, Homo sapiens
  misc_feature: GYAE6OF01EAFY2.1.63.F08.1.454.CMB.1.raw
  modified_base (220)..(220): a, c, t, g, unknown or other
  misc_feature (220)..(220): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaaagctgaccgtcgtgggtcagcccaaggctgccccacggtcactctgttccccctn

SEQ ID NO: 105732 - DNA, 280 bp, Homo sapiens
  misc_feature: GYAE6OF01C2VX8.1.63.F08.1.454.CMB.1.raw
  modified_base (253)..(280): a, c, t, g, unknown or other
  misc_feature (253)..(280): n is a, c, g, or t
tcagacgagtgcgtcacgaccggtgctcgatttagcgatcgtataaagggaaagggacagatttcacactgaaaatcagtcgtgtggaggctgaggatgttggggtttattattgcatgcaagatttccgagatcctcactttcggcggagggaccagggtggagatcaaacgaactggtggctgcaccatctgtcttacatcttcccgccatctgaacgcactcgtctgagcggctggcaaggcgcagtagnnnnnnnnnnnnnnnnnnnnnnnnnnnn

SEQ ID NO: 105733 - DNA, 254 bp, Homo sapiens
  misc_feature: GYAE6OF01AQKTD.1.63.F08.1.454.CMB.1.raw
  modified_base (250)..(254): a, c, t, g, unknown or other
  misc_feature (250)..(254): n is a, c, g, or t
tcagacgagtgcgtcacgaccggtgctcgatttagcgatcgtataaagggaaagggacagatttcacactgaaaatcagccgtgtggaggctgaggatgttggagtttattactgcatgcaagatttccgagatcctcactttcggcggagggaccagggtggagatcaaacgaactgtggctgcaccatctgtcttcatcttcccaccctcctcacgcactcgtctgagcggctggcaaggcgcatagnnnnn

SEQ ID NO: 105734 - DNA, 266 bp, Homo sapiens
  misc_feature: GYAE6OF01CF2UB.1.63.F08.1.454.CMB.1.raw
  modified_base (263)..(266): a, c, t, g, unknown or other
  misc_feature (263)..(266): n is a, c, g, or t
tcagacgagtgcgtcacgaccggtgctcgatttagcgatcgtatatcgcggggacgcggccaccctgaccatcagcagggccgacgccgggatgaggccgactattattgtcaggtgtgggatcctgataatgatcagcatgtggttttcggcggagggaccaagctgaccgtcgtgggtcagcccaaggcctcgcccccacggtcactctcgttcccgccctctctgtcgagcgtctgagcgggctggcaaggcgcatagcnnnn

SEQ ID NO: 105735 - DNA, 264 bp, Homo sapiens
  misc_feature: GYAE6OF01BVMB8.1.63.F08.1.454.CMB.1.raw
  modified_base (256)..(256): a, c, t, g, unknown or other
  misc_feature (256)..(256): n is a, c, g, or t
  modified_base (263)..(264): a, c, t, g, unknown or other
  misc_feature (263)..(264): n is a, c, g, or t
tcagacgagtgcgtcacgaccggtgctcgatttagcgatcgtatatcgcggggacgcggccaccctgaccatcagcagggccgacgccgggatgaggccgactattattgtcaggtgtgggatcctgataatgatcagcatgtggttttcggcggagggaccaagctgaccgtcgtgggtcagcccaaggctcgcccccacggtcactctcgttcccgccctcctccgtgtctgatctgagcgggctggcaaggcncatagcnn

SEQ ID NO: 105736 - DNA, 271 bp, Homo sapiens
  misc_feature: GYAE6OF01AEQXK.1.63.F08.1.454.CMB.1.raw
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (264)..(271): a, c, t, g, unknown or other
  misc_feature (264)..(271): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgttggttttcggcggagggaccaagctgaccgtcgtgggtcacgcccaaggcctcgcccccacggtcactctcgttccccaccctcctctgtcgagtcgtcngngcgggctggcgagcgcannnnnnnn

SEQ ID NO: 105737 - DNA, 273 bp, Homo sapiens
  misc_feature: GYAE6OF01EO8SN.1.63.F08.1.454.CMB.1.raw
  modified_base (262)..(273): a, c, t, g, unknown or other
  misc_feature (262)..(273): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctcgttcccaccctcctccgtgtctgatctgagcgggctggcaaggcgcatagnnnnnnnnnnnn

SEQ ID NO: 105738 - DNA, 272 bp, Homo sapiens
  misc_feature: GYAE6OF01BRCUT.1.63.F08.1.454.CMB.1.raw
  modified_base (219)..(219): a, c, t, g, unknown or other
  misc_feature (219)..(219): n is a, c, g, or t
  modified_base (252)..(272): a, c, t, g, unknown or other
  misc_feature (252)..(272): n is a, c, g, or t
tcagacgagtgcgtcacgaccggtgctcgatttagcgatcgtataaagggaaagggacagatttcacactgaaaatcagccgcgtggaggctgaagatgttggcctctatttctgggtgctaggtgtccaccttccgctcacttttggccaggggaacaacctggagatcaaacgaactgtggctgcaccatctgtcttcatcttcccgcatctgaacncactcgtctgagcgggctggcaaggcgcatagnnnnnnnnnnnnnnnnnnnnn

SEQ ID NO: 105739 - DNA, 295 bp, Homo sapiens
  misc_feature: GYAE6OF01B3OHQ.1.63.F08.1.454.CMB.1.raw
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (264)..(295): a, c, t, g, unknown or other
  misc_feature (264)..(295): n is a, c, g, or t
tcagacgagtgcgtcacgaccggtgctcgatttagcgatcgtatatcgcggggacgcggcccaccctgaccatcagcagggccgacgccggggatgaggcccgactattattgtcaggtgtgggatcctgataatgatcagcatggtggttttcggcggagggaccaagctgaccgtgtggtcacgcccaaggctccgaccccagtcactctcgttccccaacctctctgccgtgcgtngcggcggcnggacaggcganagtannnnnnnnnnnnnnnnnnnnnnnnnnnnnnnn

SEQ ID NO: 105740 - DNA, 258 bp, Homo sapiens
  misc_feature: GYAE6OF02GNXDI.1.63.F08.1.454.CMB.1.raw
  modified_base (258)..(258): a, c, t, g, unknown or other
  misc_feature (258)..(258): n is a, c, g, or t
tcagacgagtgcgtcacgaccggtgctcgatttagcgatcgtatatcgcgggacgcggccaccctgaccatcagcagggccgacgccgggatgaggccgactattattgtcaggtgtgggatcctgataatgatcagcatgtggttttcggcggagggaccaagctgaccgtcgtgggtcagcccaaggctgccccacggtcactctgttcccgccctcctccgtgtctgatctgagcgggctggcaaggcgcatagn

SEQ ID NO: 105741 - DNA, 260 bp, Homo sapiens
  misc_feature: GYAE6OF02IRE7U.1.63.F08.1.454.CMB.1.raw
  modified_base (260)..(260): a, c, t, g, unknown or other
  misc_feature (260)..(260): n is a, c, g, or t
tcagacgagtgcgtcacgaccggtgctcgatttagcgatcgtatatcgcgggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctccgtgtctgatctgagcgggctggcaaggcgcatagn

SEQ ID NO: 105742 - DNA, 263 bp, Homo sapiens
  misc_feature: GYAE6OF02G08N8.1.63.F08.1.454.CMB.1.raw
  modified_base (261)..(263): a, c, t, g, unknown or other
  misc_feature (261)..(263): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccgccctcctccgtgtctgatctgagcgggctggcaaggcgcatagnnn

SEQ ID NO: 105743 - DNA, 293 bp, Homo sapiens
  misc_feature: GYAE6OF02HQEUA.1.63.F08.1.454.CMB.1.raw
  modified_base (267)..(269): a, c, t, g, unknown or other
  misc_feature (267)..(269): n is a, c, g, or t
  modified_base (271)..(293): a, c, t, g, unknown or other
  misc_feature (271)..(293): n is a, c, g, or t
tcagacgagtgcgtcacgaccggtgctcgatttagcgatcgtatatcgcggggacggcggccaccctgaccatcagcagggcccgacgccggggatgaggccgactattattgtcaggtgtgggatcctgataagtgatcagcatgtggttttcggcggagggaccaagctgaccgtcgtgggtcagcccaaggctgcccccacggtcactctgttcccgccctcctctgtcgagtcgtctgagcgggctggcaaggcgcattaggnnnannnnnnnnnnnnnnnnnnnnnnn

SEQ ID NO: 105744 - DNA, 262 bp, Homo sapiens
  misc_feature: GYAE6OF02G4Q2J.1.63.F08.1.454.CMB.1.raw
  modified_base (261)..(262): a, c, t, g, unknown or other
  misc_feature (261)..(262): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgccccctcggtcactctgttcccaccctcctctatacgatcgctgagcgggctggcaaggcgcatagnn

SEQ ID NO: 105745 - DNA, 255 bp, Homo sapiens
  misc_feature: GYAE6OF02H5Y9E.1.63.F08.1.454.CMB.1.raw
  modified_base (251)..(255): a, c, t, g, unknown or other
  misc_feature (251)..(255): n is a, c, g, or t
tcagacgagtgcgtcacgaccggtgctcgatttagcgatcgtataaagggaaagggacagatttcacactgaaaatcagccgggtggaggctgaggatgttggagtttattactgcatgcaagatttccgagatcctcactttcggcggagggaccagggtggagatcaaacgaactgtggctgcaccatctgtcttcatcttcccgccatctgaacgcactcgtctgagcgggctggcaaggcgcatagnnnnn

SEQ ID NO: 105746 - DNA, 260 bp, Homo sapiens
  misc_feature: GYAE6OF02HKXZI.1.63.F08.1.454.CMB.1.raw
  modified_base (260)..(260): a, c, t, g, unknown or other
  misc_feature (260)..(260): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctctctgtcgagcgtctgagcgggctggcaaggcgcatagn

SEQ ID NO: 105747 - DNA, 260 bp, Homo sapiens
  misc_feature: GYAE6OF02IJ1FV.1.63.F08.1.454.CMB.1.raw
  modified_base (259)..(260): a, c, t, g, unknown or other
  misc_feature (259)..(260): n is a, c, g, or t
tcagacgagtgcgtcacgaccggtgctcgatttagcgatcgtatatcgcgggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccacctcctctgtcgagcgtctgagcgggctggcaaggcgcatagnn

SEQ ID NO: 105748 - DNA, 262 bp, Homo sapiens
  misc_feature: GYAE6OF02GCDXW.1.63.F08.1.454.CMB.1.raw
  modified_base (261)..(262): a, c, t, g, unknown or other
  misc_feature (261)..(262): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccgccctcctctgtcgagcgtctgagcgggctggcaaggcgcatagnn

SEQ ID NO: 105749 - DNA, 261 bp, Homo sapiens
  misc_feature: GYAE6OF02JEG8H.1.63.F08.1.454.CMB.1.raw
  modified_base (260)..(261): a, c, t, g, unknown or other
  misc_feature (260)..(261): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccaggtcactctgttcccgccctcctccgtgtctgatctgagcgggctggcaaggcgcatagnn

SEQ ID NO: 105750 - DNA, 282 bp, Homo sapiens
  misc_feature: GYAE6OF02JX73D.1.63.F08.1.454.CMB.1.raw
  modified_base (266)..(282): a, c, t, g, unknown or other
  misc_feature (266)..(282): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcacgtggttttcggtcggagggaccgaagctgaccgtcgtgggtcgagccaaggctgcccccgaccggtcgactctgttcccgccctcctctatcgtatactctgagcggctggcaaggcgcatagnnnnnnnnnnnnnnnnn

SEQ ID NO: 105751 - DNA, 260 bp, Homo sapiens
  misc_feature: GYAE6OF02HWUMQ.1.63.F08.1.454.CMB.1.raw
  modified_base (260)..(260): a, c, t, g, unknown or other
  misc_feature (260)..(260): n is a, c, g, or t
tcagacgagtgcgtcacgaccggtgctcgatttagcgatcgtatatcgcgggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctctgtcgagcgtctgagcgggctggcaaggcgcatagn

SEQ ID NO: 105752 - DNA, 263 bp, Homo sapiens
  misc_feature: GYAE6OF02GENU5.1.63.F08.1.454.CMB.1.raw
  modified_base (261)..(263): a, c, t, g, unknown or other
  misc_feature (261)..(263): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctccgtgtctgatctgagcgggctggcaaggcgcatagnnn

SEQ ID NO: 105753 - DNA, 264 bp, Homo sapiens
  misc_feature: GYAE6OF02GPWY8.1.63.F08.1.454.CMB.1.raw
  modified_base (261)..(264): a, c, t, g, unknown or other
  misc_feature (261)..(264): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctctatgtatactctgagcgggctggcaaggcgcatagnnnn

SEQ ID NO: 105754 - DNA, 261 bp, Homo sapiens
  misc_feature: GYAE6OF02G2211.1.63.F08.1.454.CMB.1.raw
  modified_base (260)..(261): a, c, t, g, unknown or other
  misc_feature (260)..(261): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccgccctcctccgtgtctgatctgagcgggctggcaggcgcatagnn

SEQ ID NO: 105755 - DNA, 261 bp, Homo sapiens
  misc_feature: GYAE6OF02GW8XL.1.63.F08.1.454.CMB.1.raw
  modified_base (261)..(261): a, c, t, g, unknown or other
  misc_feature (261)..(261): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccgccctcctctgtcgagcgtctgagcgggctggcaaggcgcatagn

SEQ ID NO: 105756 - DNA, 261 bp, Homo sapiens
  misc_feature: GYAE6OF02GUB8V.1.63.F08.1.454.CMB.1.raw
  modified_base (260)..(261): a, c, t, g, unknown or other
  misc_feature (260)..(261): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccaggtcactctgttcccaccctcctctgtcgagcgtctgagcgggctggcaaggcgcatagnn

SEQ ID NO: 105757 - DNA, 268 bp, Homo sapiens
  misc_feature: GYAE6OF02GVHRA.1.63.F08.1.454.CMB.1.raw
  modified_base (264)..(268): a, c, t, g, unknown or other
  misc_feature (264)..(268): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccaccctcctctatgtatacctgagcgggctggcaaggcgcatagaaaannnnn

SEQ ID NO: 105758 - DNA, 313 bp, Homo sapiens
  misc_feature: GYAE6OF02I0OZI.1.63.F08.1.454.CMB.1.raw
  modified_base (269)..(270): a, c, t, g, unknown or other
  misc_feature (269)..(270): n is a, c, g, or t
  modified_base (272)..(313): a, c, t, g, unknown or other
  misc_feature (272)..(313): n is a, c, g, or t
tcagacgagtgcgtcacgaccggtgctcgatttagcgatcgtatatcggcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgccccctggtcactcgtgttcccaccctcctctatacggactcgctggacgcgggctggcaaggcgcattaggcnntnnnnnnnnnnnnnnnnnnnnnnnnnnnnnnnnnnnnnnnnnn

SEQ ID NO: 105759 - DNA, 269 bp, Homo sapiens
  misc_feature: GYAE6OF02IU9S7.1.63.F08.1.454.CMB.1.raw
  modified_base (260)..(269): a, c, t, g, unknown or other
  misc_feature (260)..(269): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttcccgccctcctctgtcgagcgtctgagcgggctggcaaggcgcatgnnnnnnnnnn

SEQ ID NO: 105760 - DNA, 267 bp, Homo sapiens
  misc_feature: GYAE6OF02HXMB5.1.63.F08.1.454.CMB.1.raw
  modified_base (263)..(267): a, c, t, g, unknown or other
  misc_feature (263)..(267): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctgcccccacggtcactctgttccccaccctcctctgtcgagcgtctgagcgggctggcaaggcgcataggnnnnn

SEQ ID NO: 105761 - DNA, 266 bp, Homo sapiens
  misc_feature: GYAE6OF02HH4SM.1.63.F08.1.454.CMB.1.raw
  modified_base (266)..(266): a, c, t, g, unknown or other
  misc_feature (266)..(266): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctcgccccctcggtcactctcgttcccgccctcctctatacgatccgctgaggcgggctggcaaggcgacatagn

SEQ ID NO: 105762 - DNA, 324 bp, Homo sapiens
  misc_feature: GYAE6OF02JYQXM.1.63.F08.1.454.CMB.1.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (262)..(263): a, c, t, g, unknown or other
  misc_feature (262)..(263): n is a, c, g, or t
  modified_base (268)..(269): a, c, t, g, unknown or other
  misc_feature (268)..(269): n is a, c, g, or t
  modified_base (281)..(324): a, c, t, g, unknown or other
  misc_feature (281)..(324): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgactaatgatcagcatgtggttttcggcggaggaccaagctgaccgtcgtgggtcagcccaaggctgccccctggtcactctgttccccacctcctntatacgattcgctggacgngggctgcaggcgcaatggnngcatnnagtactgctagnnnnnnnnnnnnnnnnnnnnnnnnnnnnnnnnnnnnnnnnnnnn

SEQ ID NO: 105763 - DNA, 274 bp, Homo sapiens
  misc_feature: GYAE6OF02G17SW.1.63.F08.1.454.CMB.1.raw
  modified_base (263)..(274): a, c, t, g, unknown or other
  misc_feature (263)..(274): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagcccaaggctcgcccccacggtcactctcgttcccaccctcctccgtgtctgatctgagcgggctggcaaggcgcatagnnnnnnnnnnnn

SEQ ID NO: 105764 - DNA, 281 bp, Homo sapiens
  misc_feature: GYAE6OF02GDWKQ.1.63.F08.1.454.CMB.1.raw
  modified_base (266)..(281): a, c, t, g, unknown or other
  misc_feature (266)..(281): n is a, c, g, or t
tcagacgagtgcgtcacgaccggtgctcgatttagcgatcgtatatcgcggggacgcggccaccctgaccatcagcagggccgacgccgggggatgaggccgactattattgtcaggtgtgggatcctgataatgatcagcatgttggttttcggcggagggaccaagctgaccgtcgtgggtcagcccaaggctgcccccacggtcactctcgttccccgccctcctccgtgtctgatctgagcgggctggcaaggcgcagtagnnnnnnnnnnnnnnnn

SEQ ID NO: 105765 - DNA, 266 bp, Homo sapiens
  misc_feature: GYAE6OF02FH1L7.1.63.F08.1.454.CMB.1.raw
  modified_base (260)..(266): a, c, t, g, unknown or other
  misc_feature (260)..(266): n is a, c, g, or t
tcagacgagtgcgtcacgaccggtgctcgatttagcgatcgtatatcgcggggacgcggccaccctgaccatcagcagggccgacgccggggatgaggccgactattattgtcaggtgtgggatcctgataatgatcagcatgtggttttcggcggagggaccaagctgaccgtcgtgggtcagccaaggctgcccccacggtcactctcgttcccaccctcctctatgtatactctgagcggctggcaaggcgcatagnnnnnnn

SEQ ID NO: 105766 - DNA, 624 bp, Homo sapiens
  misc_feature: GYAE6OF02JVOYK.1.63.F08.1.454.CMB.1.raw
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
  modified_base (413)..(413): a, c, t, g, unknown or other
  misc_feature (413)..(413): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
  modified_base (573)..(573): a, c, t, g, unknown or other
  misc_feature (573)..(573): n is a, c, g, or t
  modified_base (586)..(586): a, c, t, g, unknown or other
  misc_feature (586)..(586): n is a, c, g, or t
tcagacgagtgcgtcacgaccggtgctcgatttagcgatcgtatatcgcgggacgcggccaccctgaccatcagcaggccgacgccgggatgagccgactattattgtcaggtgtggatcctgataatgatacgagcagttgttggttttcggcggtaggaaccgaagcgtacggaccgttcggtcgggtcgacgaccctaacggccgtcgtccccccgacggttccgaaccttccgttcccgttaccccgtaccccttcccgtacgttcgttaccggaacgtccggttcgtacggaggccgggtacgtcggaacgtaacggtccggacctagtacgtcgngagngtgacgcgngtacgtancgtcgacgcgacgtcgtactgcgcngcgtacgcgtcgtcgtcacgtagtgngatacgcgcgtcgtcgacgtcgngtcgtcgngtacgtgtgtcgtacgacgtacgacgngtacgtgtacgtacgtaactacgtcgtagtaccaccgtacttagtaccgaccgacgtagacgtagtgtacggtagacgtacgcgcgtacgtacacgacgagngtccgagtaccgngtagtgtagttcgtacgaccgtcggtacgacgtacacg

SEQ ID NO: 105767 - DNA, 528 bp, Homo sapiens
  misc_feature: GYAE6OF01A0T62.22.21.B10.1.454.CMB.1.raw
  modified_base (296)..(296): a, c, t, g, unknown or other
  misc_feature (296)..(296): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttangaggtcactaagcggcctcaggggtccctgatcgcttctctggctccaagtctggcgacacggcctccctgaccgtctcgtgggctccaggctgaggatgaggctgattatactgctactcatatgcaggcggcaacgtcgttgggtgttcggcggagggacccaaggcctaggacccgtccgtaggtcacgccccaagggcctcggacccccctgggtccacgtcgttccg

SEQ ID NO: 105768 - DNA, 571 bp, Homo sapiens
  misc_feature: GYAE6OF01EJ1RC.22.21.B10.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
  modified_base (426)..(426): a, c, t, g, unknown or other
  misc_feature (426)..(426): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctctggtaccaacaccacccaggcacacgacccccaaactcatgatttangaggtcactaagcggcctcgagggtccctgatcgcttctctggctcaagtctggcgacacggcctcccgtgaccgtctcgtggcctccgaggctggagatggagctgattattactgtctactcattangcgaggccggactaacgttcgtttaggggttcgttaccggggacgggtacgggaacccgaaggtccgtacggtacccggttccgttagggtccacggccccgaaaggccctacccgcccccgttacggcctacccgtcgttcccg

SEQ ID NO: 105769 - DNA, 537 bp, Homo sapiens
  misc_feature: GYAE6OF01EWOAD.22.21.B10.1.454.CMB.1.raw
  modified_base (396)..(396): a, c, t, g, unknown or other
  misc_feature (396)..(396): n is a, c, g, or t
  modified_base (421)..(421): a, c, t, g, unknown or other
  misc_feature (421)..(421): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcggcctcgagggtccctgatcgcttctctggctcaagtctggcgacacggcctcccgtgacccgtctcgtggctccgaggctgagntgaggctgatttatactgactactnatatgacgaggccggacaacttcgttgggtgttcgggacggaggaccagtcgtgacccggtcgtaggtcacggcccgaaggccgtccgcccccgtaggtcctaccgtcgttccccg

SEQ ID NO: 105770 - DNA, 540 bp, Homo sapiens
  misc_feature: GYAE6OF01BO4LR.22.21.B10.1.454.CMB.1.raw
  modified_base (395)..(395): a, c, t, g, unknown or other
  misc_feature (395)..(395): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccaccaggcacacgacccccaaactcatgatttatgaggtcactaagcggcctcgagggtccctgatcgcttctctggctcaagtctggcgacacggcctcctgaccgtctcgtcgggcctccgaggctgaggntgaggctagtattattacgtgtactactctatatcgcaggcgacaacgttcgttgggttgttcggcggacggacgacgcgtcgaccggtccgtaggccacgacccgaaggccgtccgacccccgtggtcctacgtccgttacccg

SEQ ID NO: 105771 - DNA, 535 bp, Homo sapiens
  misc_feature: GYAE6OF01BIMAR.22.21.B10.1.454.CMB.1.raw
  modified_base (298)..(298): a, c, t, g, unknown or other
  misc_feature (298)..(298): n is a, c, g, or t
  modified_base (428)..(428): a, c, t, g, unknown or other
  misc_feature (428)..(428): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacacgcccccaaactcatgatttangaggtcactaagcgggcctcgaggggtccctgatcgcttctctggctcaagtctggcgacacggccctccctgacccgtctcgtgggcctccaggctgagatggagctgtattattactgctactcatangcaggcgcaactcgttgggtgttcgggcggacgggaccaagcgtcgacccgtccgtaggtcacggcccgaaggcctccggcccccgtggtccacgttccgttacccg

SEQ ID NO: 105772 - DNA, 535 bp, Homo sapiens
  misc_feature: GYAE6OF01BT8BK.22.21.B10.1.454.CMB.1.raw
  modified_base (234)..(234): a, c, t, g, unknown or other
  misc_feature (234)..(234): n is a, c, g, or t
  modified_base (527)..(527): a, c, t, g, unknown or other
  misc_feature (527)..(527): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggnggttacaagtatgtctcctggtaccaacaccacccaggcacacgcccccaaaactcatgatttatgaggtcactaaggcggcctcaggggtccctgactcgcttctctggctcaagtctggcgacacggcctccctgaccgtctctgggcctccgaggctggaggagtggaggctagtattattactgtctactcattatgcgaggcggcaacgttcgttgggttcgttcgggcggacgggaccgaagccgtagacccgtcgtaggtcacgcccaaggcctcgcccctgtccnctcgtccg

SEQ ID NO: 105773 - DNA, 696 bp, Homo sapiens
  misc_feature: GYAE6OF01C4YQH.22.21.B10.1.454.CMB.1.raw
  modified_base (254)..(254): a, c, t, g, unknown or other
  misc_feature (254)..(254): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtccagtcaccatctcctgacacgtacggaaccagacagtgtacggttggtagttacaagtntcgtctccgtacgtaaccaaccaccacccgaggaccacaccgacccccaaactcatgtatttagtagacgtacaacgtaacggccggtcctacggaccgggttccctaggtactccgtccttctcgtcggtcctacgtaacgtcgtcggacgaccgacccggtccctcccgtacgaccctacttccgtccgttgggtccttaccgttaggtttacggaacggtacgtacgttaccttaactttaacgttacgtcgtacttacgttttaacctttaaagttacggcctaccgtactttcgtacggttttcgggtttcggacgggtacgaccgtaacgtaggtccgtacccgttccgttcggaccgaccgacccggacggtccccgtaccccgtccgtccgtaccttccgttccctaccccttacccctccctccgccggtacg

SEQ ID NO: 105774 - DNA, 558 bp, Homo sapiens
  misc_feature: GYAE6OF01DKA0B.22.21.B10.1.454.CMB.1.raw
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctgtaccaacaccaccagcacacgacccccaaactcatgtatttangagtcacgtaagcggcctcgacgggtccctgactcgcttctctggcctaccgaagtctggccgacgaccggccctcccgtgtacccgtctcgtcgggcctccgaggctggaggagtggaggtctagtaatttatactgcagctcatagtggagcagcgtaatagtttggtggttcgggacggacggaccaagtcgtacggacccgttcgtacggtccgacgtacccaagtccgaccgtcccgtcccccgttggtcctacccg

SEQ ID NO: 105775 - DNA, 601 bp, Homo sapiens
  misc_feature: GYAE6OF01BC073.22.21.B10.1.454.CMB.1.raw
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctcctggtaccaacaacaccaggacaaacgccccaaatcatgatttangagtcactaacgcgccctcgacgggtccctgactcgcttctcgtcggctaccgaagtcgtcggacaaccgaccggtccctacccgtcgtacccgtctccgtcgggcctccgaggcgtagaggtagtggagtctagtaatttagttactgtctgcttactagtttcgcgtaggcctaccttacgtacgtttgggtcgttcgggacgggtacggaccgtaggtccgtcggtacccgtcgtacggtcacggcccgaacggtcctacccggtccccgttcggtaccctaccttccgtccgttccccccg

SEQ ID NO: 105776 - DNA, 542 bp, Homo sapiens
  misc_feature: GYAE6OF01AUSZJ.22.21.B10.1.454.CMB.1.raw
  modified_base (296)..(296): a, c, t, g, unknown or other
  misc_feature (296)..(296): n is a, c, g, or t
  modified_base (530)..(530): a, c, t, g, unknown or other
  misc_feature (530)..(530): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctcctggtaccaacaccaccaggcacacgcccccaaactcatgatttangaggtcactaagcgggctcgagggtccctgatcgcttctctggctccaagtctggcgacacggccctcctgacccgtctcgtgggcctccgaggctggaggatggaggtctagtatttacttacgtgctactcatatgcgaggcgactaacgttcgttgggtgttcgggcggacggaccagtccgtagaccgtcgtagggtcacggccccgaaggccctcgcccccgtggtccncgttccgtcccg

SEQ ID NO: 105777 - DNA, 571 bp, Homo sapiens
  misc_feature: GYAE6OF01DWH66.22.21.B10.1.454.CMB.1.raw
  modified_base (302)..(302): a, c, t, g, unknown or other
  misc_feature (302)..(302): n is a, c, g, or t
  modified_base (403)..(403): a, c, t, g, unknown or other
  misc_feature (403)..(403): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatcctcctgcactggaaccagcagtgacgttggtggttacaagtatgtctcctggtaccaacacccacccaggcacacgacccccaaactcatgatttangagtcactaaggcggcctcgacgggtccctgactcgcttctcgtgctcaagtctggcgacacggcctcccgtgaccgtctcgtcgggctccgaggctgagngtgagtctgtaattattactgcttactactatatgacgacggcggactaacgttcggtttagggttcggttcgggacggtagggacccgtaaggtcctacggacccggttccgtagggtccacggacccgaacggccgtacgcccccgtacgtcctacgtccttcccg

SEQ ID NO: 105778 - DNA, 574 bp, Homo sapiens
  misc_feature: GYAE6OF01EKQKC.22.21.B10.1.454.CMB.1.raw
  modified_base (564)..(564): a, c, t, g, unknown or other
  misc_feature (564)..(564): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccaccaggcacacgacccccaaactcactgactttatgacggtcacgtaacggcggcctcgaggggtccctgactcgcttctctggctcaagtctggcgacgacggcctcccgtgaccgtctcgtcgggcctccgacggtctaggacggacgttggaggtctgtaactttagttactgacttactctattatgcgagggcgactaacgttcggttcgggttcgttcgggacgggacgggaccgaagtccgtacgtaccgtccgtaggtcgacgcccgtaaggcctccgacccccgtggtccnctcgttcccg

SEQ ID NO: 105779 - DNA, 564 bp, Homo sapiens
  misc_feature: GYAE6OF01DPXOD.22.21.B10.1.454.CMB.1.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctcctggtaccaacaccacccaggcacacgcccccaaatcatgatttangagtcactaagcggcctcgaggggtccctgatcgcttctctggctccaagtctggcgacaccggcctccctgacccgtctcgtgggcctccgaggctggaggatggaggctgtaatttattactgctactcatatgcgaggcggactaacgttcggttcggggttcgttcgggacggacgggtaccaaggtccgtacggacccggttccgtaggtccgacgacccgaaggccgtccgccccccgtaggtcctaccgtcgttccccg

SEQ ID NO: 105780 - DNA, 603 bp, Homo sapiens
  misc_feature: GYAE6OF01EKDCR.22.21.B10.1.454.CMB.1.raw
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctggtaccaacaccaccagcacacgccccaaactcatgatttangaggtcaacgtaagcggcctcgacgggtccctgactcgcttctctggctccaagtctggcacaccggcctccctgaccgtctcgtcgggtcctccgacggctaggaggagttggaacggcgtagtagtttaacttaccgtgtaccttaactcctaattacgtcgacgtacgggccggactaacgttcgtttaggggttcggtttacgggacgggaacgggaccaacggtcgtacggtacccgttccgtagggtccacgacccgaaggtccgtccgtcccccgtaggtccctaccgttccgttaccccgg

SEQ ID NO: 105781 - DNA, 516 bp, Homo sapiens
  misc_feature: GYAE6OF01C9AE6.22.21.B10.1.454.CMB.1.raw
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
  modified_base (507)..(507): a, c, t, g, unknown or other
  misc_feature (507)..(507): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgtttggtggttacaagtatgtctcctggtaccaacaccacccaggcacagcccccaaatcatgatttatgaggtcactaagcgggctcaggggtccctgatcgcttctctgctccaagtctggcacacggcctccctgaccgtctcgtgggctccgaggctgaggatggaggctagattattactgctactcatntgcaggcgcaacttgttgggtgttcgggnggagggaccagcctgccgtcgtaggtcacgcccgaaggctccgccccgtgtccnctcgtcccg

SEQ ID NO: 105782 - DNA, 554 bp, Homo sapiens
  misc_feature: GYAE6OF01B1HBO.22.21.B10.1.454.CMB.1.raw
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgacccgtctctgggcctccgaggctgaggatgaggctgatttattactgctactcatatgcaggcggcaacgttcgttgggttcgttcgggcgggtagggaccgaaaggcctaggacccggtccgtagggtccacggaccccgaagggcctccggccccccgttcggtcctaccgtccgttcccgg

SEQ ID NO: 105783 - DNA, 636 bp, Homo sapiens
  misc_feature: GYAE6OF01BPQRF.22.21.B10.1.454.CMB.1.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (369)..(369): a, c, t, g, unknown or other
  misc_feature (369)..(369): n is a, c, g, or t
  modified_base (484)..(484): a, c, t, g, unknown or other
  misc_feature (484)..(484): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtntgtctcctgtaccaacaccaccaggcacacgaccccaaactcatgatttangacgtcactaagcggcctcgacgggtcctgactcgtcttctcgttggcctaccgtaacggtctcgggaccgaacnccgggcccttcccgtaggaccccgttcgtccgtcgggccttacccgagggccttagggacgggtaattgggacggtcttaggtaattttacgttaccgtagccgtaagtccttanaagttaagcgggaagcgagacgaacgttagtttcggtggttacgggacgggaaggacccgaggtccgtacggacccgttacaggggttacccacggttaccccggaagggtccctacccgggtaccccccgttcggccgttacccgttcccg

SEQ ID NO: 105784 - DNA, 524 bp, Homo sapiens
  misc_feature: GYAE6OF01A6K2E.22.21.B10.1.454.CMB.1.raw
  modified_base (296)..(297): a, c, t, g, unknown or other
  misc_feature (296)..(297): n is a, c, g, or t
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctcctggtaccaacaccacccaggcacacgcccccaaatcaatgatttannaggtcactaagcgggcctcgaggggtcccctgatcgcttctctggctccaagtctggcgacacggccctcctgaccgtctcgtgggcctccgaggctgaggatggaggctgtattatttactgtcctactcatatgcaggcgcaacttcgttgggtgttcggcggaggccagctgaccgtcgtaggtcncgcccgaaggctccgccccctggtccncgtccgttccg

SEQ ID NO: 105785 - DNA, 549 bp, Homo sapiens
  misc_feature: GYAE6OF01BFKOH.22.21.B10.1.454.CMB.1.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtatgtctctgtaccaacaccaccaggcacacgacccccaaatcatgatttangagtcacgtagccgcctcgacgggtccctgactcgcttctctgctacagtcngacaacncgcctccgtgtactcgtctcgtcggcctcgaggctggaggtatggagtcgtagtacttatacgtgacagtctacatgtggagcagtacgtattaagttggtcgttacgggacggtacggtaccaaggtccgtacggtacccgtcgtacggtacaccgacccgtacggccctcccggcccccgtggtccctacccg

SEQ ID NO: 105786 - DNA, 632 bp, Homo sapiens
  misc_feature: GYAE6OF01EH0VR.22.21.B10.1.454.CMB.1.raw
  modified_base (221)..(221): a, c, t, g, unknown or other
  misc_feature (221)..(221): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtggttacagtatgtctctggtaccaacaccaccaggcacacgcccccaaactcatgatttangaggtcactaagcggcctcgagggtccctgactcgcttctctgctccgaagtctggcgacaccggcctccctgacccgtctcgtcgggcctccgacggtcctaggaggtagtcggaggtctagtaactttacgttaccgttgtaccttaacgtctaattacgtcggacgtaagggccggtactaaccgttcggtttcggggttcggtttaccggggacggggtaacgggtacctaaagggccgttacgggtaacccggttaccgttagggtacccaacggaccccgaaacggtccgttaccgccccgttacccgtccgggttccctaccgttcccg

SEQ ID NO: 105787 - DNA, 617 bp, Homo sapiens
  misc_feature: GYAE6OF01BTH92.22.21.B10.1.454.CMB.1.raw
  modified_base (220)..(220): a, c, t, g, unknown or other
  misc_feature (220)..(220): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctcctgcactggaaccngcagtgacgttggtgttacagtatgtctctggtaccaacnccaccaggcacacgcccccaaatcatgatttngagtcactaagcggcctcgacgggtcctgactcgtcttctctggcctaccgagtcgtcggcgacaccggccctcccgtgaccgtctcgtcgggcctccgaggtctggaggtactggaggtctagtatttacgttactgtaccttacgtctagttaagtcggtacgacgggaccgtactaaccggttcggtttgggttcgggttaccgggacgggaacgggaccgtaagtccgtaccggtacccggttcgtagggtaccgaccggacccgaacgggtccccgtcccggtaccccccgttggtaccctcccgttccgttacccccgg

SEQ ID NO: 105788 - DNA, 548 bp, Homo sapiens
  misc_feature: GYAE6OF01AXL5H.22.21.B10.1.454.CMB.1.raw
  modified_base (298)..(298): a, c, t, g, unknown or other
  misc_feature (298)..(298): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacacccacccaggcacagcccccaaactcatgatttangaggtcactaagcggcctcgaggggtccctgatcgcttctctggctcaagtctggcgacacggtccctcccgtgacccgtctcgtcgggcctccgaggctggaggatgaggctgtactttattactgcttactctatatgcgacggcggactaacgttcgttgggttcgttcggcgggacgggaccaagccgtagacccgtcgtaggtcacggcccaaggcctccgccccgtcggtcctcgtccgtcccg

SEQ ID NO: 105789 - DNA, 534 bp, Homo sapiens
  misc_feature: GYAE6OF01BG99C.22.21.B10.1.454.CMB.1.raw
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctggtaccaacaccacccaggcacacgcccccaaatcatgatttatgaggtcacgtaagccggctcgagggtccctgatcgcttctctggctcagtctggcacacggcctcctgaccgtctctgggctcaggctgagtatgaggctgattattactgctactcatatgcaggcgactaacgttcgttgggtcgttcgggcggtacggaccagtccgtaggaccgtccgtaggtccacggccccgaaggcccgtccgcccccgttggtcctacgtccgttacccg

SEQ ID NO: 105790 - DNA, 521 bp, Homo sapiens
  misc_feature: GYAE6OF01ETP3U.22.21.B10.1.454.CMB.1.raw
  modified_base (296)..(296): a, c, t, g, unknown or other
  misc_feature (296)..(296): n is a, c, g, or t
  modified_base (367)..(367): a, c, t, g, unknown or other
  misc_feature (367)..(367): n is a, c, g, or t
  modified_base (490)..(490): a, c, t, g, unknown or other
  misc_feature (490)..(490): n is a, c, g, or t
  modified_base (512)..(512): a, c, t, g, unknown or other
  misc_feature (512)..(512): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctctggtaccaacaccaccaggcacacgcccccaaactcatgatttangaggtcactaagcggcctcgaggggtccctgactcgcttctctggctcaagtctggcgacacggcctcccngaccgtctcgtcgggcctccgaggtctggaggatggaggctgtatttattacgtgtactactctatatgcaggcgactacgttgttgggttgtcggcggaggacagcgtagccgtcgtaggcncgcccaggcctcgcccctgtcncgtctcccg

SEQ ID NO: 105791 - DNA, 596 bp, Homo sapiens
  misc_feature: GYAE6OF01B53UU.22.21.B10.1.454.CMB.1.raw
  modified_base (299)..(299): a, c, t, g, unknown or other
  misc_feature (299)..(299): n is a, c, g, or t
  modified_base (497)..(497): a, c, t, g, unknown or other
  misc_feature (497)..(497): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccagcacacgacccccaaactcatgatttangagtcactaagcgggcctcgacgggtccctgatcgcttctctggctccgaagtcgtcggcgaccaccggtccctcccgtgacccgtctccgtcgggcctccgaggtctaggacggagtggacggtctagtattattacgtgaccttacgtcaattatcgcgacggccgtacaaccgttcgttgggttggttaccgggnggaacgggtaccgaaggtccgtacggacccggttccgtaggtccggacgaccccgaaggccctcccggtccccccgtcggtacctccgtcgttccccgg

SEQ ID NO: 105792 - DNA, 746 bp, Homo sapiens
  misc_feature: GYAE6OF01BPH4P.22.21.B10.1.454.CMB.1.raw
  modified_base (256)..(256): a, c, t, g, unknown or other
  misc_feature (256)..(256): n is a, c, g, or t
  modified_base (319)..(319): a, c, t, g, unknown or other
  misc_feature (319)..(319): n is a, c, g, or t
  modified_base (410)..(410): a, c, t, g, unknown or other
  misc_feature (410)..(410): n is a, c, g, or t
tcagacatacgcgtcacgaccggtgctcgatttagtgtcgtcgcaaggggggggttctcgaggaggcagcgctctcaggacgtcaccaccatcggcctgggctctgctcctcctcagcctcctcactcagggcacacgggtcctgggacccagtctgccctgactcagcctccctcgccgtccgggtctcctggactacgtcagtccaccatcctcctgcacgtcggaaccagcagtgacgttggtagtacaagtntcgtctcgtacgtaccaacaccaccgaggccacgaccgaccccaaacgtcatcgtatttacgnggacgtcacgtacggccggtacctcgacgggtcctagtacgtcgtcttcgcggtcggactacgagtcgcggcgtacgtccggtcctaccgngtaccgtctccggtcggaccttcggacggtctacgggacgttagtcggtaacggttctaggttaactttacttaccggtcgtaccttaccgttacgtaacgttacggtacgtaccgggtaccgggttacccggtaaccgtttaacccgggtttcggggtttcgggggttacggtacccgggggaaacgggtaccggggttaaccgtaaacggttcccgggtaaaccggtaaccccggtttcggttaaaccggggtccacccgggtaaccccgtacggttacccgttcccccggaccccggtttaggtacccttcccggtttccccgttacccccgg

SEQ ID NO: 105793 - DNA, 664 bp, Homo sapiens
  misc_feature: GYAE6OF01BSE0D.22.21.B10.1.454.CMB.1.raw
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctctggtaccaacaccaccaggcacacgaccccaaatcatgtatttagngaggtcacgtaaggccggtcctcgacgggtcccngactcgtcttctcgtcggcctaccgaagtccgtcgggaccgaccgaccggtcccttcccgtagaccccgttcgtccgtcgggcctccgaggtctggaggtatggacggtctagtaactttacgttactcgtaccttactctaagttacgtcggacgtacgggacgtaccgttaacgttcggtttaggggttcggttacggggtacgggaacgggtaaccggtaacgtaccggtccgtaacccggtcccggttagggttaccgaccggacccggtaaccggtccgttacccgttaccccggttacccggtaccttcccgttccgttacccccgg

SEQ ID NO: 105794 - DNA, 597 bp, Homo sapiens
  misc_feature: GYAE6OF01EF7N1.22.21.B10.1.454.CMB.1.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctctgtaccaacaccaccaggcacacgcccccaaatcatgatttangaggtcactaagcggcctcgagggtccctgactcgtcttctctggcctccgaagtcgtggccgaccgaccggccctcccgtcgtacccgtctccgtcgggtcctccgaggtctaggaggagtggaggtctagtaactttattacgtcgtcttactacattagtcgacgaggacggactaacgttcggtttgggttcggttccgggcgggaacggtaccgaacggtcgtacggtacccgtccgtaggtccgacggacccgtaaggccctccggtacccccgtggtcctaccgtccgttaccccg

SEQ ID NO: 105795 - DNA, 613 bp, Homo sapiens
  misc_feature: GYAE6OF01C5K1F.22.21.B10.1.454.CMB.1.raw
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctcctggtaaccaacaccaacccaggcacacgcccccaaatcatgatttangagtcaacgtaaggccggtctcgacggggtccctgatcgtcgttctctggcctctaagtcgtggacaaccgaccggtccctcccgtgacccgtctcgtcgggcctaccgagggtcctagggacggagttggacgtcgttagtaatttacttacgtcgacncgtctacagtagtgggancgagcgtactaagttttcggtaggttcggacgggacggaaccgagtcgtacggtaaccccggtgtaacgggtcgaacccggtaccgaacgggtccccgtccggtaccccccgtttcgggaccctccgtttacccgg

SEQ ID NO: 105796 - DNA, 687 bp, Homo sapiens
  misc_feature: GYAE6OF01ELI7N.22.21.B10.1.454.CMB.1.raw
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacagtcagtcaccatcctcctgcactggaaccagcagtgacgttggtgtacagtatgtctctgtaccaacaccaccagcacacgaccccaatcatgtatttangtacgtacacgtaacggccggcctcggacgggtccctgactcgtcttctcgtcggctacgagtcgtaggaccaaccgccggtccctcccgtcgtacccgttcgtacggtcgggtcctaccggacggtcgtaggacggtagtcggacggtacgtagttaactttacgttacgtgacgtacgtcttacgtaagttaggtagggaacgacgacggtaccgttaacgtttaaggttttcgggtacgggttaccggggaccggggtaacgggtaacccgtaggtaccggtaccgggtacccggttacggtaaccgggtaccgaacccggtacccggaaaccgggttcccgttaccccgggtacccccgttccgggttacccgtcccggtttacccccgg

SEQ ID NO: 105797 - DNA, 618 bp, Homo sapiens
  misc_feature: GYAE6OF01AISL9.22.21.B10.1.454.CMB.1.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcatccgggtctcctggacagtcagtcaccatctcctgcactggaaccngcagtgacgttggtggttacagtatgtctctggtaccaacaccaccaggcacacgccccaaatcatgtatttangacgtcacgtaacgcggcctcgacggggtccctgacgtcgcttctcgtcggcctcgagtctggccgaccgaccggtccctcccgtgacccgttctcgtcgggcctccgaggctggaggatggacggtctagtactttacgttacgtcgtctactctatagtcgcgaggcgtactacgttcggttgggtcgttacgggcgggtaacgggaccctaacggtccgttaccggtacccggttaccgttaacgggtccgtaaccgggaccccgaacgggtccccgtacccggtcccccccggtttcgggtcccgtaccggttccccgg

SEQ ID NO: 105798 - DNA, 592 bp, Homo sapiens
  misc_feature: GYAE6OF01BDOA8.22.21.B10.1.454.CMB.1.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtggttacaagtntgtctctggtaccaacaccacccaggcacacgccccaaactcatgatttatgaggtcactaagcggcctcgagggtccctgatcgcttctctggctcaagtctggcgacgacgccctccctgaccgtctcgtcgggctccgaggctggagtatggacgctgtatttatactgtactactcattatgacgacggcggactaacgttcggtttaggggtcggttcgggacgggtaacgggacccaaggtcccgtaggaaccccgttccggtaaggttacgaaccggaccccgaaagggtcccttacccggccccccgttagggttaccctaccgttccgttaccccgg

SEQ ID NO: 105799 - DNA, 530 bp, Homo sapiens
  misc_feature: GYAE6OF01BJYE9.22.21.B10.1.454.CMB.1.raw
  modified_base (208)..(208): a, c, t, g, unknown or other
  misc_feature (208)..(208): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
tcagacatacgcgtcacgaccggtgctcgatttagtgtcgtcgcaaggggggggtctcaggaggcagcgctctcaggacgtctccaccatggcctgggctctgctattcctcaccttcctcactcagggcacagggtcctggcccagtctgccctgacccagcctgcctccgtgtctggatcatctggacagtcgatcagcatttccngcactgggaccaacagtgactattgggtcttttgactctgtctcctggtaccaacaacacccaggaccaaaccccccaactcactcatttatgtgtcactcgtcgccctcagagtctctcatcgcttcncagctcagtctgcacncgcctccaacatctctcggctctagttgaggacgngtactacttattactgtactagtttaccttaattcggtcncctactcgttcggttggtttcggcggtacgtcacgtagtcgacgtcctcggtacacgccgagcgtccgcccgtcgtcaccgtctccgtccctccgtcctccg

SEQ ID NO: 105800 - DNA, 635 bp, Homo sapiens
  misc_feature: GYAE6OF01AO2W1.22.21.B10.1.454.CMB.1.raw
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
tcagacatacgcgtcacgaccggtgctcgatttagtgtcgtcgcaaggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtcttttgactctgtctcctggtaccaacaacaccacggccaaaccccccatcatctattatggtcgtcacgtcgtccggccctcgaggacgtctctcatcgcttcncgagctaccaagtctacggcaacncgcctccaacnctctcgtcggcctcgtagttcgaggtacgtacgtacttacttacgttactcgtctaagtttacctttaaagtacgcgtcctacgttcgttcggttcggtttcggcgggtacggtaccgtaaccggtacggtaccggtaccgttcccgtacggttccgaaccgtccccgaaacgggttccctacccggtcccccgttccgggtactaccccgttccgttcccgtttacccccaccccgtttcccgtcccgtacccggg

SEQ ID NO: 105801 - DNA, 684 bp, Homo sapiens
  misc_feature: GYAE6OF01CC7KJ.22.21.B10.1.454.CMB.1.raw
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatcctcctgcactggaaccagcagtgacgttggtgttacaagtntgtctctgtaccaacaccaccaggcacacgacccccaaatcatgtatttangagtcaacgtaaggcggtcctcgacgggtcccngactcgtacttcncgtggcctacaagtcgtggacccgacgaccggtcccttcccgtcgtacccgttcctacggtcgggtccctccgaacgggtccgtagggacggtagtcggacggtacgttacgtaatttacgttaaccgtcgtaccttaccgtactagttacgtacggacgtacgggaccggtacgtaacgtttcgggttaggggtttacggttacggggtaccgggtaacgggtaacccgtaacggtaccgtaccggttaccccggtcccgttacggtacccgacggtaccccgaacggtccccgtaccggtaccccccgtaggtaccctaccgttcccgtttacccccgg

SEQ ID NO: 105802 - DNA, 635 bp, Homo sapiens
  misc_feature: GYAE6OF01CNTNP.22.21.B10.1.454.CMB.1.raw
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
  modified_base (470)..(470): a, c, t, g, unknown or other
  misc_feature (470)..(470): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctcgccctgactcacgcctccctccgcgtccgggtctccgtggacagtcagtcaccatcctcctgcactcggaaccagcagtgacgttggtagttacaagtntgtctctcggtaaccaacaccaccgaggcaccacgaccccaactcatgatttatagngtacactaaggcggctcgacggtccctgactcgtcttctcgtcgctacagtcgtcggcgacgacggccctccgacgtccgtcgtcgtacggtctaccgaggtctagggacggacgtggacgtcgtagtacgtttacttacgtctacgtactacgtattacgngacggagtccggacttaaccgttgggttcggggttacgttcggggaccggtacggtaaccgtacggtcgtaccggtaacccggttcgtacggtaccgaacggaccccgaagggtcccgtacccggccccgttaccggttcctaacccgttccgtttaacccccgg

SEQ ID NO: 105803 - DNA, 640 bp, Homo sapiens
  misc_feature: GYAE6OF01DT4I6.22.21.B10.1.454.CMB.1.raw
  modified_base (263)..(263): a, c, t, g, unknown or other
  misc_feature (263)..(263): n is a, c, g, or t
  modified_base (591)..(591): a, c, t, g, unknown or other
  misc_feature (591)..(591): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcgagggcacgacgggtccgtgggcccagtctcgccctgactcacgcctccctcgcgtccggtctcgtggacagtcacgtcaccatcctcctgccacgtacggaacctaggctagtcgacggtttggtacggttacaagtntcgtctccgtaggtaccaacaccaccgagccacgaccgaccccaagcagtgtaatttgaggtacgtacaacgtacggccggtccgtacggacgggttccaggtactccgtctcgtcgtcgcctacgtagtcgacgccgaccgtccggtcctccgacgtccgtcgtcgtcggcctcgacggtcgtaggacgtagtggacgtgtacgttattacgttcgtcgtaccttactagttatacggtcgaacgcggggtaccctacggttacgtttcgggttgggttcggtcgggacggtaccgacggtacgcgtaccggacgttccgtaggacncccggtacgacgccctcccggtaccctcggtacctccgtccggtccccg

SEQ ID NO: 105804 - DNA, 743 bp, Homo sapiens
  misc_feature: GYAE6OF01EL2AH.22.21.B10.1.454.CMB.1.raw
  modified_base (323)..(323): a, c, t, g, unknown or other
  misc_feature (323)..(323): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatcctcctgctacgtacggaaccagcagtgtacggttggtacgtaacgaagtatgtcctcgtacggtaaccaaacaaccaccgacggaccaaaccgacccctaaactcatagtatttagngacggtcaacgtaacggccggtcctacggtacgggtcctggacttccgtcttcgtcgtcggtacctaccgtaagtccgtacggaccgaaccgtcccggtccctcccgtacggtacccttcgtccggtcgggtcctccgaggtcgtaggtacggtagacggtacggacgttacgtaagttacttacgtcggtacctacgtcgtacctaagtacggtacgggaacgggacgtaacggtaccggtaacgtttaacggtttacgggttacggggttaccggggtaccggggtaaccgggtaaccgtaaccggtacggtacccggttaacccggttaccggttaccgggtaccggtaccggacccgtaaacgggtccgtaccccggtccccgtacccggttaccttccggtcccgttcccccggg

SEQ ID NO: 105805 - DNA, 555 bp, Homo sapiens
  misc_feature: GYAE6OF01BDGXP.22.21.B10.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccgggtctccgtggacagtcagtcaccatctcctgcactggaaccngcagtgacggttggtgttaacaagtntgtctctgtaccaacnccaccagcacacgaccccaactcatgtactttagtcgagtcaactaaggcggcctcgacgggtcctgactcgtcttcncgtcgctccgaagtcgngcgacgacgcctccgtgaccgtctcgtgctcgngtcngagagtgacggtcgtacgtatttacgtacgtcgtactacgtnactancgacgagcgtcaacgtcgttggtcgttcggacggacggacgaacgtccgtacgtacggtcctaggtcgaccgaccacggcctcccgtcccgtacgtctccctcgtaccccg

SEQ ID NO: 105806 - DNA, 633 bp, Homo sapiens
  misc_feature: GYAE6OF01A42EQ.22.21.B10.1.454.CMB.1.raw
  modified_base (335)..(335): a, c, t, g, unknown or other
  misc_feature (335)..(335): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctcctgtaccaacaccaccaggcacacgacccccaaatcatgatttatgagtcactaagcggcctgacgggtccctgactcgcttcnctggctcagtcgtcgcgacacggcctacccgtgtacccgttctccgtcgggcccttccgacgggtcctacgggaggacgttacggacgggtcttacggtaattttacgtttaaccttggtcctttaacgttacctaattacgttcggacgtagggtccggtacctaaccgttccggtttaggggtttcgggttccggggtacgggacgggaccgtaacgtcgtacggtacccgtccgttaaggtccaacggcccaacgggtcccgtaccgccccccgttggccctacgtccgttcccg

SEQ ID NO: 105807 - DNA, 633 bp, Homo sapiens
  misc_feature: GYAE6OF01CRJHN.22.21.B10.1.454.CMB.1.raw
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcacatctcctgcactcggaaccagcagtgacgttggtgttacagtatgtctctgtacaacaccaccaggcacacgacccccaaatcatgatttangnggtacacaagccggcctcgacgggtcctgactcgtcttctctggctcgaagtcgtggcgacaccgtcctcccgtgacccggtctcgtcgggtctccgaggtcaggaggtatggtacggtcttagtaagttttacttaaccgttgactaccttctaactttagcgtacgagggtacggtaaccgtaacgttcgggttttggggtcggtttaccggggcgggtaacggggaaccctaacggtccgtggtaaccccggtaccgttacgggtaccgaaccggtcccgtaaagggtcccgtacccggtccccgttcggtacccctacgtcccggtttacccccg

SEQ ID NO: 105808 - DNA, 619 bp, Homo sapiens
  misc_feature: GYAE6OF01CDCCI.22.21.B10.1.454.CMB.1.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacagtntgtctctggtaccaacaccaccaggcacacgcccccaaactcatgtatttagnggtacgtcaacgtaaggccggtcctcggacgggttccctgactcgtcttcgtcgtcggcctacctaaggtccgtacggcgaccgaccggtccctcccgtcgtaccgttcctcgtcgggcctccgacggtcgtaggacggtagtggacggtcgtagtaactttacttacgtcgtccgttactactaattacgtgacgacgggacgtaccgtaacgttcggttgggttcgttccgggacgggacgggaccgacggtcgtcggtaccgtcgtagtacgacgaccgaacgtccgtcccgtccccgtacgtcctccgtccgttcccg

SEQ ID NO: 105809 - DNA, 594 bp, Homo sapiens
  misc_feature: GYAE6OF01BHVHV.22.21.B10.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (387)..(387): a, c, t, g, unknown or other
  misc_feature (387)..(387): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctccngcactggaaccagcagtgacgttggtgttacaagtntgtctctggtaccaacaccaccaggcacacgccccaaactcatgatttangagtcactaagcggcctcgagggtccctgatcgcttctctgctccaagtcnggcgacgacggcctcccgtcgaccgtctcgtcgggctccgnggctgaggatggaggtcgtgtaatttattacgtcgtacttactctattatcgacgacggtcggactaaccgttcgtttgggttcggttacgggcgggtaacgggaccgaagccgtacggtacccggtccgttacggtaccggacgacccggaaacggtcccgttccggtaccccccgtacggtccctacccgttccgttacccccgg

SEQ ID NO: 105810 - DNA, 610 bp, Homo sapiens
  misc_feature: GYAE6OF01EY2CQ.22.21.B10.1.454.CMB.1.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccngcagtgacgttggtgtacagtntgtctcctgtaccaanacccaccaggcacacgacccccaaactcatgatttangaggtcataacggcggtcctcgacgggtccctagtactcgcttctgtcggcctacgagtctggaccgaccgaccggccctcccgtcgtacccgtcgtcgtcggggtcctccgaggtccttggaggtagtcggaggtcgtagtagtttacgttactcgtactactactatagtcgacgtacggccgtaccgtacgtcggtttagggtcgttcgggacggtacggacgtaacgtcgtacgtacccggtcgttacggaccgacgacccgaacggtcccgtaccgtacccccggttagtacccttcgtcccgttacccg

SEQ ID NO: 105811 - DNA, 726 bp, Homo sapiens
  misc_feature: GYAE6OF01E4OBB.22.21.B10.1.454.CMB.1.raw
  modified_base (251)..(251): a, c, t, g, unknown or other
  misc_feature (251)..(251): n is a, c, g, or t
  modified_base (310)..(310): a, c, t, g, unknown or other
  misc_feature (310)..(310): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctgggcccagtctgccctgactcagcctccctccgcgtccgggtctccgtggacagtcagtcaccatctcctgcactggaaccagcagtgacgttggtggttaacaagttntgtcctcctcggtaaccaacacccaccgagccacacgacccccaaatcatgtatttagngacggtacaacgtaacggccggacctcgtaccggggtcctagtactccgtacttcgtccgtcggtcctaccgtaacggtcgtacgggaccgaaccgacccggtcccttaccccgtacggtaccccgttcgtccggtcgggtcctaccggacggtacgttacgggacgggtagtacgggaacgtcgtaggttaactttacgtttacgtacgtaccgttaccgtactagtaagttcgaacgggtacggaccggtaccgtaacgtttcgggttaggggttcggttaccgggacggggaacggtaccgaacggtacgtacccggttacccggtccggttaagttaccggaccgtacccggaacggttcccgtacccgggtaccccccgtacggttaccctacccggttccgtttcccccg

SEQ ID NO: 105812 - DNA, 747 bp, Homo sapiens
  misc_feature: GYAE6OF01EJUC9.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcgagggcacacgggtcctcgggcccagtctcgccctgactcacgcctccgtccgcggtccgggtctccgtggactagtcacgtccacctactcctcctgcacgtacggaaccagcgaggtcggtacggtttgggtaggttaacaaggttctcgtccttccgttacggtaaccaaccacccaaccgacggaccaaccaccgaaccccaaactctattacgtatttagcggtacgtacaacgtaacggccggtcctcgggtacgggtccctagtactcgtcttcgtcgtcgtacctacgtaacgtcgtcggacgtaccgaccggtcccttacccgtccgtaccggtcgttccgggtccgggtaccgtaccggacggttacgtagggtaacgggtagtacgggtaacgttcggttaaggttaacttttacggttaccgttcggtaccttacgtacgtaacgttcgtcggaaccgtcgggaccgttacgtacggtttcgggttgggttcggtcggggacggtacggaacgtcggtacggccgttaccggttcgggtacggaccgtaccggacccggtaacggtcccgtcccggtacccggtaccgttccgtcccgttccgttccccg

SEQ ID NO: 105813 - DNA, 602 bp, Homo sapiens
  misc_feature: GYAE6OF01C6PJG.22.21.B10.1.454.CMB.1.raw
  modified_base (208)..(208): a, c, t, g, unknown or other
  misc_feature (208)..(208): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctgggcccagtctgccctgactcagccctccctccgcgtccgggtctcctggacagtcagtcaccatcncctgcactggaaccagcagtgacgtttggtggttacaagtatcgtctctggtaccaacaccaccaggcacacgaccccaaatcatgtatttatgacggtacacgtaagccgggcctcgacgggtccctgactcgcttctctcggctccaagtctcggacacgacggcctccgtgaccgtctcgcgggtcctccgaggctcggagtagtggaggcgttagtactttattactcgtacttactctaatacgtcgtacggaggtccggtacctaacgttcggtttcggggtcgttacggggacggtacgggaaccgtagcgtacgacccgttcgtacgggtacacgacccgaaggcccgtaccggtcccccgtagggtccctcggttcccttacccg

SEQ ID NO: 105814 - DNA, 726 bp, Homo sapiens
  misc_feature: GYAE6OF01AMGEE.22.21.B10.1.454.CMB.1.raw
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
  modified_base (312)..(312): a, c, t, g, unknown or other
  misc_feature (312)..(312): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcgagggcacgagggtcctgggcccagtctcgccctgactcacgccctcccctccgcggtcccgggtctccgtggaccagtcacgtccaccatcctcctgcacgtcggaaccngcagtgtacgttggtgtacagtntgtctctcgtaccaacacccaccgagccacgaccaccccaactcatgatttangtaggtacacgtagcggcctcggaccgggtcctgacgtcgtcttctcgtcgtcctacgacgtcgtggccgtacagtccggtccctacccgtcgtacccgtctccggtacgggtccctccgacgggtcgtacgggtacggtacgtacgggacgggtcgttaggttaacttttaaccgttaccggttcgtaccgttacctacgttaactcgtacggtcggaaccggggttaccgtaaccgttaaccggtttcgggttcggggttcgggttacccggggacggggtacgggtaaccgaaccggtccgttaccggtaccccggttaccgggtaccgggtacccgaacccggtacccggtaaccgggtcccgttaccccggtccccccggttaccgggtccctacccggtttcccccgg

SEQ ID NO: 105815 - DNA, 551 bp, Homo sapiens
  misc_feature: GYAE6OF01BCAH2.22.21.B10.1.454.CMB.1.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (420)..(420): a, c, t, g, unknown or other
  misc_feature (420)..(420): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctcctggtaccaacaccaccaggcacacgacccccaaactcatgatttangaggtcacgtaaggcgggcctcgacggggtccctggactcgtcttctctggcctaccgaagtcgtcggcgacgaccggtccctcccgtcgtaccgtctcgtcgggcctccgaggctggaggngtagaggtctagtattattacgtgtactactctatatgcgaggcgcaacgttcgttgggtgtcggcggtaggaccagtcgtcgaccgtcgtaggcacgccgaaggcctccgccccgtcgcctctcgtcccg

SEQ ID NO: 105816 - DNA, 606 bp, Homo sapiens
  misc_feature: GYAE6OF01CJDOQ.22.21.B10.1.454.CMB.1.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcacatctcctgcactggaaccngcagtgacgttggtgttacagtntgtctctgtaccaacaccaccaggcacacgacccccaaactcatgtatttatggacgtcaacgtaaggccggtcctcggacgggtccctgactcgtcttctcgtcggctacagtctggcgacaccgcctcccgtcgtaccgtctcgtggcctcgaggtctggagagtggagtctagtattactacgtgtacctactactatcgtcgacgacggaccgacgtaacgttcggttaggggttcgttacggggacggaacgggacctacggtccgtaccgtacccggtccggtacggaccgaccggacccgtaagggcccttacccggtcccccctaccggtccctaccgttcccgttacccccgg

SEQ ID NO: 105817 - DNA, 952 bp, Homo sapiens
  misc_feature: GYAE6OF01CABBI.22.21.B10.1.454.CMB.1.raw
  modified_base (225)..(225): a, c, t, g, unknown or other
  misc_feature (225)..(225): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacagtcagtccaccatcctcctgcactggaaccngcagtgtacggttggtaggttacaagtatgtctccgtacggtaaccaaccacccaccgaggccaaccgacccgaaccccctaaactcaactagttaactttagacggtacggtaccaaccgtaacggcccgggtaccctacgggtaccggggttaccctaggttaccgttcccgttccgttttccgtaccggttcggtaccccttaaccggtaaacgttcccgggtacggtaaaccccgtaaacccgggtaccccggttcccccgttaccccggtttaccggtaaccccggtttccgttcccgggggtttaaccggggtcccccgtttaacccgggtaaccggggttaccgttaacggggggtaacggtacggtttaaccggggtaccgggttaaccggttaaggtttaaaccttttaccgttaacggtcggtaaccgtacgttaccgttaacgtaacgggtttaaggtacggggaacgggtaccgtaaaccgggtaccgttaaaacggttttacgggttttacggggttaaccggggttaccgggggaaacccggggttaaccgggaaacccgtaacgggtttacccgggtaccggttaaccccgggttaccggggtaaccgggtaacccggtaaccccgggtaaaccccgggtcccggggttaacccctccccccggggtttacccccggttacggttaccccgtacccggttttaaccccccgg

SEQ ID NO: 105818 - DNA, 576 bp, Homo sapiens
  misc_feature: GYAE6OF01DXQ7Q.22.21.B10.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctcgccctgactcagccctccctcgcgtccggtctcctggacagtcagtcacntctcctgcactcggaaccngcagtgacgttggtgttacaagtntgtctctagtaccaacaccaccagcacacgaccccaaatcatgtatttangtagtcacgtaagccggtctcgacgggtccctgactcgtcttctcgtgcctactacgtcgtcggaccgacaccggtcctcccgtcgaccgttccgtcgtcgggtaccttccgacggtcgtacggaggtagtggacggtactagtactttaacgttactcgtaccttactctagtacgtgacgcggcgtacctacgttcgttgggtcgttcggacgggacggacacgcgtagacccgtcgtagcacgccgaggtcctccgtaccctgtcctcgtccgtcccg

SEQ ID NO: 105819 - DNA, 670 bp, Homo sapiens
  misc_feature: GYAE6OF01B45ZE.22.21.B10.1.454.CMB.1.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactggaaccngcagtgacgttggtagtacagtntgtctctgtaccaacaccaccagcacacgaccccaatcatgtatttangacgtacacgtaggcggcctcgacgggtccctagtactcgtcttcgtcgtcggtcctaccgtaagttccgtacgggaccgaccgaccggtcccctcccgtacggaccccgttctaccggtcgggtcctaccggacggtccgtagggaacggtagttacggaggttacgtaggttaacttttacgttacgtacgtaccttactactaattacgtcggacgacgggtaccggtaccgtaacgtttcggggtttacggggttcgggttaccggggacggggtaacggacgtaacggtccgtccggtacccgtcggttacggcgaccggacccgtaacggcccgtcccggtaccccgttcggcctccgtccgttcccccgg

SEQ ID NO: 105820 - DNA, 573 bp, Homo sapiens
  misc_feature: GYAE6OF01BWQZZ.22.21.B10.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtccaccatctcctgcactggaaccngcagtgacgttggtgttacaagtntgtctctggtaccaacaccaccaggcacacgacccccaaactcatgatttangagtcacgtaagcggcctcgacgggtccctgatccgcttctctggctcgaagttcgtggccacgacggccctcccgtgaccgtctcgtggctccgagctgaggagtgacggtctagtatttatacgtgcttactcatatgcgacggcggactaacgttcgttagggtcgttcgggacggacgggtaccacggtccgtacggacccgttcgtacggccgtaccggacccgaacggcctaccggcccccgttggtaccctaccgttccgttaccccg

SEQ ID NO: 105821 - DNA, 803 bp, Homo sapiens
  misc_feature: GYAE6OF01DSOVB.22.21.B10.1.454.CMB.1.raw
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctgggcccagtctcgccctgactcagcctccctccgcgtccgggtctccgtggacagtcagtcaccatcctcctgcacgtcggaaccagcagtgtacggttggtaggttaacaagttntggtcctccgtcggtaaccaaccacccgacccacggcacgaccgacccccaaatcagtntaatttanggtacggtcaacgtaacggccggtacctcggtacgggtccctagacgtcgtctttcgtcgtcggcctacgtaacgttccgtcggaccgaaccggcccggtccccttacccggtacggtaaccccggttcgttccggtccggggtccttacccggaggtccgtaggagggtaacgttgggacgtcttagttaacttttacgttacgtccgttacttaccgtactaagtttacgcggtacggtaacgggccggtaaaccgtttacgggttcgggttttacgggggttcggttacccgggggacgggtaacgggtaacccgtaaccgggtcccggttaaacccgggtaccccgggtttaaccggtaaccggggttacccaaacccggggtaaccccgtaacgggttcccccgttacccccggggttaccccccgtttaccggggttaaccctccccggttttccccggtttccccccccggg

SEQ ID NO: 105822 - DNA, 715 bp, Homo sapiens
  misc_feature: GYAE6OF01DD6NT.22.21.B10.1.454.CMB.1.raw
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcgagggcacgacgggtcctgggcccagtctcgccctgactcacgccctccgtccgcgtccgggtctccgtggacagtcagtcaaccatccncctgccacgtcggaaccagcaggtcgcggtttggacggttaacaagtnttcgcttcgtcgtaaccaacaccaccaggccaacaccgaccccaaactacactgtaactttatacggagtctaactaacggccggtacctcggacgggtccctagctccgtcttcgtcgtcggtcctacgtaacgttcggcggacgtaccgaccggtccctccgtcgaccgttctcgtcggcctccgacggctagggacgtagtcggaggtacgtaacgttatttactacgtcgtaacctccttacgtatcgtcgacgaacggcgtaacccttaggtttacggtcggggttacgggttccggggcggtaacggggaaccctagggtaccgttcgtaaccccgggttacggtaacggtacccggtaaacccggtaccggttaacccgggtcccgttaacccccggcccccgggtttaagaaccccgtacccggtttccccgtttaacccccgg

SEQ ID NO: 105823 - DNA, 760 bp, Homo sapiens
  misc_feature: GYAE6OF01CBAB0.22.21.B10.1.454.CMB.1.raw
  modified_base (258)..(258): a, c, t, g, unknown or other
  misc_feature (258)..(258): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctgggcccagtctgccctgactcacgcctccctcgcgtccgggtctcctggacagtcagtccaccattcctcctgcactcggaaaccagcagtcgtacggttgggtagttaacaagttntcggtctccgtaggtaccaacagaccacccgaggacaaacgcccccaagacctacatctatttactgtctagtacaatacgccggcctacgacgggtccctgactcgtacttcgtcgtcggtcctacgaacgttcgtacgggacctaaccgtacccgggtcccttaccccgtaggaacccctaacgtttcccgttaccggttcgggtccctaccggtacggccgttaaggtaaacgtagtacggaggtccgttaaggttaacgtttaacgttacgttcgtcgttacgtaccgttgttaacggttttcggaccggtaccgggttaccggtaccctttaacggttaccgggttttcggggttaccgggtttaccggggaccggggtaaaccgggtaacccgtaaacggtccggttaccggtaacccggttcccggtaacggtacccgacccggtaccccggtaacgggtccccgttcccgggtacccccgttcggttaaccccg

SEQ ID NO: 105824 - DNA, 831 bp, Homo sapiens
  misc_feature: GYAE6OF01B68HL.22.21.B10.1.454.CMB.1.raw
  modified_base (154)..(154): a, c, t, g, unknown or other
  misc_feature (154)..(154): n is a, c, g, or t
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
  modified_base (805)..(805): a, c, t, g, unknown or other
  misc_feature (805)..(805): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcacgccctcctcactcgagggccacgtacgggtcctgggcccnggttcctcggcccctagaccttccgacgtcccttcccgtccggtccggtccgggttctaccgtggacctacggtcagtccacgtactccncgtgactacgtcggaaccagcctaagtcgtacggtttaggtacgttaaccgaagttntccgtcgttaccccgttaggtaaccccaaaccacccggaacccgacggttccaaaccacccggaaccccctaaaattccgaacgtacgttaagtttaacgtcggtacggtaacctaacgtaaccggccgggtacctaccgggtaccgggttacccgtgtacccgtcggttccttcccgtcggtacgtccgttaacggacggttccgagggtacccaccgtccggttccctccgtacgtaccgtcttcgggccgtactaccggtgtacggtaccggagtacgtacgtacggtacgtaacttacggtttaccttcgtaccgtacctaccttcgaacgtttgacgacggtacggtacccgtacgtaccgttttgggttaccgggttcggtaaccggggtcgaacccgggttaacaacggtcccgtaacccggggttaccgtaaccgggttaccggtaacccgcgggttaacccccggatccccgggttaccggtaccccggtttacnccccttacgggtttacccccgtcccg

SEQ ID NO: 105825 - DNA, 883 bp, Homo sapiens
  misc_feature: GYAE6OF01BGWG6.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcacgcctcctcactcagggcacgagggtcctgggcccagtctgccctgactcagccctccctccgcgtccgggtctccgtggacagtcagtcacatcctcctgcacgtagaaccagcagtgacgttggaggttaacaagtatcgtctaccgtcggtaaccaaccaccaaccgacggaccaacaacccgacccccaaaactcgaattagtaattttaacgaggtaacggtaccaacgtaaacgggtccggtaccgtacggtaccggggttccctaggtaacgttccgtccttcctccgtacggtaccttaccgtaaggttccgtacgggaccgtaaccggtacccggtccctacccggtacgtacccggttccgttacggtacggggtacccttaccgggaccgggtacgttaacgggggaacggttaccgttaggggaacggttaccgttaaggttaacgtttttaaacgtttaacccgtaggttaacccgtttacgttaaccgtaaacgtttaacggttacgggaaccggtaaccgggggtaccgtaacccgtaaacgttttccgggggttttacgggttcggggttaaccgggggacgggggtaaaaccggggtacccgtaacggttacccggttaacgggttaaaccccgggtccgggtttaaccggtaccggaaaccccggtacccgggtaaacccggtcccggtttcccccggacccccgggtttaccggtaccccttaacccggtttcccggtttaacccccccgg

SEQ ID NO: 105826 - DNA, 657 bp, Homo sapiens
  misc_feature: GYAE6OF01A9DQV.22.21.B10.1.454.CMB.1.raw
  modified_base (205)..(205): a, c, t, g, unknown or other
  misc_feature (205)..(205): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccntctcctgcacgtggaaccagcagtgacgttggtagttacaagtntgtctcctaggtaccaacaccaccaggccacacgacccccaaactcatgatttangagtcacgtaggcggcctcgagggtcctgactcgcttcnctcggctcagtctggaccgacgaccggtccctccgtacgtacccgttctcgtacgggcctcccgaggccgtagaagtcgtacgacggtccttagtacttttacgttacgtcgtccgtagtcccttagttacgtttccggacgtaacgggtcctacccgttaacgttcggtttacggggtcgtttacggggaccgggaacggtaaccctaggtacccttacccgggttaccgtacggtccgaccggtcccgaaacgggtccctacccgggtccccccgttacgggtaccctccgttcccgtcccggttacccccc

SEQ ID NO: 105827 - DNA, 903 bp, Homo sapiens
  misc_feature: GYAE6OF01A89KX.22.21.B10.1.454.CMB.1.raw
  modified_base (236)..(236): a, c, t, g, unknown or other
  misc_feature (236)..(236): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcacgcctcctcactcagggcacgagggtcctgggcccagtctgccctgacctcacgccctccctccgtcgtccgggtcctccgtggactgtcacgtccaccactcctcctcgcacgtcggaaccngcagtgtacggttggtagtacaggtattcgtcctccgtaacgtaacccaaccgaccctaaccgaggacccaaccgacccgtaaccccctaaaccgtctaagtttacgttaacgttttaacgcggggtaaccgttacgaacccggttaacgggcccggttacccggtacgggtaccggggttaccccttaggacgttcccggttcctttaccggtccgtacgttcccgtaaccgtaagggtccgtacggaaccggtaccccgtaccggtccccgttaccgtccggttaccgtccgtacggttcccgggtaccgttaccgtacgggttaccggtacggtaacggttacggtagggtaccgtcggtttaacgtttaacgtttaacgttaccgttacgttaccgttacgtacgttagttaacgtacgtaaccggtaccgggttaccggtaccgtttaacccggtttcggggtttacggggttaccgggtaccggggtacgggttaaccccgggaaacgtacccgggtaccggtaccgggttaacccggttaccggttaacccgggtacccggtacccgggtaccccggttacccgggtaccccggtttccccggtaccccccggtttacggttacccccggttaaccggttccccgggtttacccccccgg

SEQ ID NO: 105828 - DNA, 827 bp, Homo sapiens
  misc_feature: GYAE6OF01CJG4F.22.21.B10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcgagggcacgagggtcctgggcccagtctcgccctgactcacgcctccctccgcgtccggtctcctggacngtcagtcacntctctgcactcggaccagcagtcgtacggttggtagttacaagtntgtctccgtgtaccaacaccaccgaggccacaccgaccccaaactcgatacgtattttagacgtacgtcaacgtaacggccgggtacctcgggaccggggtccctagacgtccggttacttcgtccgttcggtacctaccgtaacggtcgtacggaccgtacccgacccggtcccttccccgtagtaccccgtttcgtccggtccgggtacctcccggagggtaccggttagggaacgggtacgttacggaccggttcgttaggttaattttacgttaaccttccggtaaccttttactaaccgtaagttacgtccggtacgtaccgggtaccgttaaccgtacccgggttttcgggttcggggtttacgggttacccggggaacccgggggtaacgggtaaccccgtaaacggggttccggtaacccgggttacccggttttacccggtaacccggggtttaccggaaacccgggtacccccggtaaaccgggttcccccggttacccccgggtaccccccgggtttacccgttaaacccgttcccccgggtttaccccgttttccccccccgggg

SEQ ID NO: 105829 - DNA, 776 bp, Homo sapiens
  misc_feature: GYAE6OF01DI9TP.22.21.B10.1.454.CMB.1.raw
  modified_base (349)..(349): a, c, t, g, unknown or other
  misc_feature (349)..(349): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtccaccatcctcctgacactacggaaacccagccaaggttgtaaccggtttgggtgggtttaacaagttagttcggtccttccgtacggtaaccaaccacccgaaccccgaggccaaccaccgacccccaaacgtccagtacgtattttagnggacggtacacgtaacggccgggtcctacggtacggggtccctgtactccgtacttctcgtcggtcctaccgtaacggtcgtgggtaccgaccgaccggtccccttcccgtcgtacccgttccgtcgtccggggcctcccggtaacggccggttaggagggtacgtgggtacggtcgttagtaacgttttaatttaccgtcgttaccttaacgtcttaacgtaacgttgtaaccggtacggtaccgggtaaccttaacggtttcgggtttcggggttacgggttaccggggtaccggggtaacggggaaaccgaagggtcccgttaccgggaacccgtttaccggtacggtacccgaccggtaccccggtaacggtcccgtaccccggtccccgttcgggtacctaccccgtttccgttacccccgg

SEQ ID NO: 105830 - DNA, 772 bp, Homo sapiens
  misc_feature: GYAE6OF01BBRL0.22.21.B10.1.454.CMB.1.raw
  modified_base (272)..(272): a, c, t, g, unknown or other
  misc_feature (272)..(272): n is a, c, g, or t
  modified_base (310)..(310): a, c, t, g, unknown or other
  misc_feature (310)..(310): n is a, c, g, or t
tcagacatacgcgtcacgaccggtgctcgatttagtgtcgtcgcaagggggggtctcaggaggcagcgctctcaggacgtcaccaccatggcctggctctgctcctcctcagcctcctcactcaggcacagggtcctgggcccagtctgccctgactcagcctcctccgcgtccgggtctcctggacagtcagtcaccatctcctgaccacgtacggaaccagccagtcgacggtttggtcggttaacaagtatcgtctcctggtaccaacnccaccaggcacacgccccaaactcgatacgacttttanagtaacggtccaacgttaacgccggtcccctcggaccggggttcccctagtaactccgtcttccgtcgtcggtcctaccgaagtcgtacggcctaacgccgggccctacccgtgtacccgttcgtacgtcgggactcccgaggtccgttagggacggtagtcgggaacggtcttacgtaacgttttacgttaacgttcgacccgtaggtccgtacgttaaggtacggttacgggaaggtacctaagggtaccgtaaacgtttaaggttttcggggtaccggggttttacccggggaaccggggttaaaccgggacccgttaaacggtaccggttacccgggtaaacccggtttacccggttaccgggtaacccgtaccccgggtaccccggtaaacggggtaccccgttaccccggttacccccccgtaccggggtttaccccttaccccggtttaccccgg

SEQ ID NO: 105831 - DNA, 670 bp, Homo sapiens
  misc_feature: GYAE6OF01A84T7.22.21.B10.1.454.CMB.1.raw
  modified_base (133)..(133): a, c, t, g, unknown or other
  misc_feature (133)..(133): n is a, c, g, or t
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcaggcacgngggtcctgggcccagtctgccctgactcacgccctccctccgcgtccgggtctccgtggacngtcagtccaccatcctcctgcacctggaaccagcagtgacggttggtgttacagtntgtctctggtaccaacaccaccaggcacacgcccccaaactcatgatttangtaggcaacgtaagcggcctcgacgggtccctgactcgtcttctcgtacggtcctaccgtaagtcctcgggtcgaaccgaccggtcccctccgtcggacccgttcgtcgtcgggtacccttcccgacgggtccttagggaggtacgtggaacggtcctagttactttacttacgtgtacctactacgtatacttacgggctacgggtaccgacttaaccgttcggtttccggggttaaggtttcccggggacgggtaacggtaccgaccggtactccgggtacccggtcgttaacggtccgaacggaccccgtaccggttccgtaccccggtcccccggttacgtcccgtaccgttccgttacccccg

SEQ ID NO: 105832 - DNA, 825 bp, Homo sapiens
  misc_feature: GYAE6OF01CVUQU.22.21.B10.1.454.CMB.1.raw
  modified_base (193)..(193): a, c, t, g, unknown or other
  misc_feature (193)..(193): n is a, c, g, or t
  modified_base (248)..(248): a, c, t, g, unknown or other
  misc_feature (248)..(248): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctgggcccagtctgccctgactcacgcctccctccgcgtccggtctcctggacngtcagtcaccatcctcctgcactcggaaccagcagtgacgttggtcgtacaagtntcgtctccgtacggtaaccaacacccaccgacggccaacaccaccccaaatcatgtattagtgagtacacgtaacgccgggtactccggtacgggtccctagtacgtccgtcttcgtcgtcgtcctacgtacgtcgacggcaccgacccggtcccgtcccgtacggtacccgttcgtccgtacgggtccgtacccgtacggtacgtcgggtaacgggtacggtacggtaacggtcgttaacggttaacgttttaacgtttaaccgtttacggtaaccctttaaccgttaccgttaaacttaacggttacccggtaccggttaaacggggtacccggtaaccggttttaaaccgggttccggggttttaccggggtttacggggttaccccgggggtaacgggggtaaacccgggtaaaccgggtaaccggtaccgggttaacccggttaaccccgggtttacccggtaaccgggtaacccgtaaccccgggtacccggtaaacccggttccccggttacccccggtaccccccggttaccggttaccccgttacccgttaccccgtttaccccccgg

SEQ ID NO: 105833 - DNA, 675 bp, Homo sapiens
  misc_feature: GYAE6OF01D359Q.22.21.B10.1.454.CMB.1.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
tcagacatacgcgtcacgaccggtgctcgatttagtgtcgtcgcaagggggggtctcaggaggcagcgctctcaggacgtcaccaccatggcctggctctgctcctctcagcctcctcgactcagggcacagggtcctggcccagtctgccctgactcagcctcctcgcgtccggtctccgtggacagtccagtcacctatctcctgcacgtggaaccngcagtgacgttgngttacagtngtctctgtacaacaccaccagcacacgccccaaatcatgatttangtacgtcaacgtaacgcggtcctcgacgggtccctggactcgtcttctacgtcggtctaccaaggttcctgggacccgtaaccgtacccggtccctaccccgtggtaaccccgttccgttccgttaccggggtccttcccgaacggtcctaacggtagggtacttagggtacgggtcgttacggtaacttttaacgttaccgttacgtctacggtccttacgttacgttttcggacgtacggtccgtacccgttacgttacgtttcgggttacggttccgggacgggtacggaccctaaggtccgtacgtcccggttaccgtacggtaccggacgacccgtacggtccgtaccccgtcccccggagttcccgacgttcccgttaccccg

SEQ ID NO: 105834 - DNA, 634 bp, Homo sapiens
  misc_feature: GYAE6OF01BQG4F.22.21.B10.1.454.CMB.1.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacagggtcctgggcccagtctgccctgactcagccctccctccgcgtccgggtctcctggacagtcagtccaccatcctcctgcatcggaaccngcagtgacgttggtgtacagtntgtctctgtaccaanaccaccagacaacgccccaaatcatagtatttanggagtcaactaggccgcctcgacgggtccctgactcgtcttctcgtggctaccgaagtcgtggaccaaccgaccggtccctcccgtcgacccgttctcgtcgggcctccgaggtctggagtagtgggacgtcctagttactttacgttacgtcgacgacgtctacgtagttagcgggtacggcgtaacggacgtaaccgtttaaggtttcgggtaggttccggggacggaaccgggacaacggtccgtaccggtaccgtcggtacggtacgaaccggtccgtaaccgggtccctaccccggtccccgttacggttccgtcccgttccggttacccccg

SEQ ID NO: 105835 - DNA, 690 bp, Homo sapiens
  misc_feature: GYAE6OF01A16Q4.22.21.B10.1.454.CMB.1.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccngcagtgacgttggtgttacagtntgtctctggtaccacaccaccaggcacacgacccccaatcatgatttagngagtcactagcggcctcgacgggtcctgactcgtcttctcgtcggctaccgagtccgtaggccgaccaccggccctccgtcggtacccgtctcggtcgggcctccgaggtctaggacggatggacggtcgttagtaactttacgtttaccgtcgtaccttaaccgttactaagtttacgtcggacggtaacggggtccgggaccgttaaacccggtttggtttacgggggtttcgtttacccggggggaccgggtaaccgggtaaaccgaacggtcccggttaccggtaaccccgggttcgttaaccgggttcccaacgggtacccccggtaacgggtccccgttaccccgggtccccccggttacgggtcccttacccgttcccggtttacccccg

SEQ ID NO: 105836 - DNA, 717 bp, Homo sapiens
  misc_feature: GYAE6OF01CRFZF.22.21.B10.1.454.CMB.1.raw
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
tcagacatacgcgtcacgaccggtgctcgatttagtgtcgtcgcaaggggggggtctcgaggaggcagcgctctcaggacgtcaccaccatggcctgggctctgctcctcctcagcctcctcactcgagggcacgagggtcctgggcccagtctgccctgactcagcctcctcgcgtcggtctcgtggacngtcagtcacatcctccngcactggaaccngcagtcgtacggttggtagttacaagtntcgtctcctggtaaccaaccaccacccgacggccaacgaccgacccccaaaacgtccagtacgtatttactaggtacggtactaacgtaaacggccgggtacctccggtaacgggtcccgtagacgtccggtccttcgtccgtcggtcctaccgtaacgttccgacggaccgtccgaccggtcccgttcccgtacgtacccgtcgttcgtcgggcccttacggcggtcgtacgggagtacggtgggtacgtacgttacggttaatttacgttaacgtcgtacccttacgtacttaagttacgtccgggacggtaaccggccggtaaccgtttaaccgggtcggtttacggggttcggttccggggacggtacgggaactcggtaccgtcgtacccggtccgtacggtacgtccggaccgtaccggccgttaccggcccccgttaccgtccttcgtcccgttaacccccg

SEQ ID NO: 105837 - DNA, 772 bp, Homo sapiens
  misc_feature: GYAE6OF01DJHMW.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctgggcccagtctgccctgactcagcctccctccgcgtccgggtctccgtggacagtcagtcaccatctcctgcacgtaggaaccagcagtgtacgttggtagttacaagtatgtctcgtacgtaccaacaccaccaggacacaccgaccccaactcatgtatttgagtacgtacaacgtacggcggtacctacgtacgggtcctgtacttcgtccttcgtcgtcggtactaccgtaagttccgtacggaccgaacccggtccgtaccccgttcccgtcggtaaccccgttcgttaccggttccgggtacccttacccggacgggtacttacggggaaggtacgtacgggtaacggtaccgttagtttaacgtttaacgtttacgtcggtaccttacgttacctaagttaacgtcgtacggacggtaccggtacctaaccgggtttcgggtttacggggttacgggttaccggggtacgggggaaccggtaaccggtaaccgggtaccgttacccgggttaacccggttaccgttacggggtacccgtaaccgggtacccggaaccgggtccccgttccccggttaccccccggttacggtcccttacccgtttcccggtttacccccccggg

SEQ ID NO: 105838 - DNA, 849 bp, Homo sapiens
  misc_feature: GYAE6OF01A1FY0.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctcgggcccagtctcgccctgactcacgccctccctccgcgtccgggtctccgtggacagtcacgtccaccactcctcctgcacgtacggaaccagcgtagtcgtacggttggtgttaacagttactcgtctacgtacggtaacccaaccaacgacccgaagaccaaaccgaccccaaactcaatagtactttagacggtacgtaccaacggtaacggcccgtacccgtgggtaccgggtccctaggtacgtccgtacctttcgtcgtcggtaccttaccgtaacgttcgtaccggaaccgtaaacccgtacccggtcccttacccgtacggttacccggtttccgtccgggttaccggacccgttaccggacgggtacggtaacgggtagggtacgtacgggtacggttacgttaagttaacgtttacgtacgtacgtacgtacgttacgttacgtacggttgggaacgggtccggaacgtacggtaaccggtttaacggtttaggggtttaccgggggtttacggtaaccgggggtaccggggaaccgggtaacccggtaacgggttacccggttaaccgggttacccgggtaacccgggttacccgggacccggtaacccggtaccccgggtaacggtccccggttaaccccggtccccccggttacggttaccccgttccccgtttaccccgggtttacccccccg

SEQ ID NO: 105839 - DNA, 716 bp, Homo sapiens
  misc_feature: GYAE6OF01BENMA.22.21.B10.1.454.CMB.1.raw
  modified_base (245)..(245): a, c, t, g, unknown or other
  misc_feature (245)..(245): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatcctcctgcactggaaccagcaagtgacgttggtgttacaagtntgtctctggtaccaacacccaccgaggccacacgaccccccaaactccattacgattttagtagaggtccaacgtaacggccgggtcctacggacgggttccctagactcgtcttctcgtcggtccttaccgaagttccgtgggaccgtaccgtacccgggccccttacccgtacggtacccgttccgttaccgttcggggtcccttaccgtaacgggcttaacgggaggtagtagggaacggttccgtagttaatttacgtttactcgtacctaactcgtaacgttagacgtcggacggtaccgtaccgtaaccgttcggttttcggggtacgggttcccggggacggggtacgggtacccgaacgttccggttaccgtaacccggtaccggttacggacgtacccgggaccccgtaaggtcccgttacccggtcccccgttaccggtccctccgttccccgtaccccgg

SEQ ID NO: 105840 - DNA, 883 bp, Homo sapiens
  misc_feature: GYAE6OF01AUJFP.22.21.B10.1.454.CMB.1.raw
  modified_base (210)..(210): a, c, t, g, unknown or other
  misc_feature (210)..(210): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctccngcactggaaccagcagtgacgttggtggttacagtatgtctcgtggtaccaacaccaccaggcacacgacccccaaactcatacgtatttagtaggtacggtactacgtaacggccgggtcctacggacggggtcccctgaagttccgtaccgtttccgtccgtcggtcctacccgtaaaggttccgtagggtacccgaacccgtaaccgggtcccccttaccccgtaccgggtaaccccggtttccgttacccgggttacggggtcccttacccggaacggggtccggttacgggtaacggggtacggttacgggtaacgggtaccttaggttaaacgttttaacgtttaccgttacggttacccttaacgttacccgttaagttaacgtcggtaccggtaaccggggtacccgggtaccttaaacccgggtttcgggttttacggggtttacccggggttacccgggggaaccgggggttaacccggggaaacccggtaacgggtacccggttaacccgggtaaccccgggtttaccccgggtttaacggggtaccccggtaaccccgggtacccgggaaacccgggttaccggttacccccgggttaccccccccgggttaccgggtttaacccccggtaccccggtttccccggtttacccccccgggg

SEQ ID NO: 105841 - DNA, 674 bp, Homo sapiens
  misc_feature: GYAE6OF01EAU92.22.21.B10.1.454.CMB.1.raw
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcacgccctcctcactcagggcacgagggtcctgggcccagtctgccctgactcagtccctccctcgccgtccgggtctccgtggacagtcagtcaccatcctcctgcacgtcggaaccagctagtgtaccgttgggtacgttacaagtntcgtctccgtgtaaccaacaccaccagcacaccaccccaaactcatntattatgagtcacgtacgcggcctcgacgggtcctgctccgtcttctcgtgcctactagtccgcggaccgaccgaccggtccctcccgtacggtacccgtcgtccggttcgggtccttacccggacgtcggtaggacggtaggtcggaggtacttagttacttattactctacgtactacgtattacgtcggacggtacgggtaccgtaaccgttaagtttccgggtttcgggttacgggtccgggtaccgggtaaccgggtaacgacgtccggtacccgggaccgttacggtacggacctacccggtacccggtacggccgtccccggttaccccggtaccggtccttaccgtcccttacccccgg

SEQ ID NO: 105842 - DNA, 595 bp, Homo sapiens
  misc_feature: GYAE6OF01A2B2M.22.21.B10.1.454.CMB.1.raw
  modified_base (222)..(222): a, c, t, g, unknown or other
  misc_feature (222)..(222): n is a, c, g, or t
  modified_base (582)..(582): a, c, t, g, unknown or other
  misc_feature (582)..(582): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactcggaaccngcagtgacgttggtgttacagtatgtctctgtaccaacaccaccagcacacgccccaaactcatgtactttatgagtacacgtaagcggcctcgacgggtccctgactcgtcttcgtcgtcgctcaagtctggcgacgaccggcctccgtcgaccgtctcgtcgggcctccgacggcgtaggacggtagtggacggtcttagtaactttacgttaaccgtcggtaccttactccgtaattacgtgggacgaacgggcggtacgtaccgttcggtttgggtcgggttcgggacgggacggacgacgtcgtacggtacccgtcgtaggtcgacgcccgacgtccgtccgaccccgtgtaccnccgttccgtcccg

SEQ ID NO: 105843 - DNA, 687 bp, Homo sapiens
  misc_feature: GYAE6OF01AJ2YE.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgccactaggaaccagcagtgacgttggtggttacaagtatgtctcctggtaccaacacccaccgaggccacaccgacccccaaactccatgtaatttagagagtcaacgtaacgccggtcctacggacgggtccctgactccgcttctcgtcggctaccgacgtctcgggccacgccggtccctcccgtcgacccgttctcgtcgggcctccgaggtcgtggaggtactggtacggtcttcgtaatttacgtacgtcgacgtcgtcgtacagttacgggtaaggacggtacgtacggtaaccgttaacgttaagggtttcgggtaccgggttacggggaaccgggtaaccgggtaaccaaacgggttcccgtaaccggtacccggttccgttaacggcccggtaaacccggcccggtaaccggttccccggttaccccggtccccccggttacggtccccttaccccggttcccccgg

SEQ ID NO: 105844 - DNA, 709 bp, Homo sapiens
  misc_feature: GYAE6OF01AT802.22.21.B10.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (398)..(398): a, c, t, g, unknown or other
  misc_feature (398)..(398): n is a, c, g, or t
tcagacatacgcgtcacgaccggtgctcgatttagtgtcgtcgcaaggggggggtctcgaggaggcagcgctctcaggacgtcaccaccatggcctgggctctgctcctcctcacgcctcctcactccgagggcacgtacgggtcctcgggcccagtctcgccctgactcacgccctccctccgcggtccggtctccgtggacngtcagtcaccatcctcctgcacgtcggaccagcgtagtcgtacgttggtagttacaagtntgtcctccgtacgtaaccaacacccgaccgagaccaccgaccgaacccctaatcatacgtatttagcggtacgtacacgtacggccggtacctcggacggtccctgtacctcgtcttcgtcgtcggactaccgngtccgcggacgaccgtccgtccctcccgtgtaccgtccgtcgcggtaccacggtggcttagggacgtgtacgggtacgtcgttaacgttacgtttacgttaccgtactcccgttactacgttaggttacacgggtaccggacggttaccggtaccgttacggttgggtacgggttcggtaccgggaaccggacgggtacgacgtaccggtacggtacccgtacgggtccggtaaccgccggtaaccgggtaccgcccccggttaccccggtacccccgttcgtacccttcccgttccccggttacccccgg

SEQ ID NO: 105845 - DNA, 781 bp, Homo sapiens
  misc_feature: GYAE6OF01BK06Z.22.21.B10.1.454.CMB.1.raw
tcagacatacgcgtcacgaccggtgctcgattttagtgtcgtcgcaaggggggggtctcgaggaggcagcgctctcaggacgtcaaccacatggcctgggctctcgctcctcctcacgcctcctcactcagggcacgtagggtcctgggcccagtctgccctgacctcacgtccctccctccgccgtccggtctccgtggacagtcagtcacatctcctgcacgtacggaaccagctaggtgtacggttggttagtaacagttatcgtactccgttacgtacctaacacccacctagaccacgaccgaaccccaactcaatcgtatttacgacgtacggtacctacgtacgggtccggtccttacgggaccgggtccctagtaccgtccgtccttcgtcgtcggacttacgtaagtccgtcggacgtacccggccgtccctcccgtacgtcccgttcgtaccgtcggtacctaccgacgtcgtaggaacgtcgacggcgtcgtaagttacttaacgttaccgtcgtaccttaacgttcgtaacgttcgtaccgacggtaaccggggacccttaaaccggttaccggtttagggtttaccggggtttacccgggtttacggggaaccgggtaaacccggtaacccggtaaacgttcccgggttaaacccggtacggtaacccggggttacggtaaacccacccggtacccgggaaaccggtttcccgaccccggtttaccccgggtttccgaaccgttcccgttaccccggttaccccccgg

SEQ ID NO: 105846 - DNA, 787 bp, Homo sapiens
  misc_feature: GYAE6OF01EMDUL.22.21.B10.1.454.CMB.1.raw
  modified_base (352)..(352): a, c, t, g, unknown or other
  misc_feature (352)..(352): n is a, c, g, or t
  modified_base (592)..(592): a, c, t, g, unknown or other
  misc_feature (592)..(592): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcacgcctcctcactcgagggccacgagggtcccgtcggccctaggtcctcgccctgacctcgacgccctcccgtccggtccggtccgggtctccgtggacctacgtcgtaacgtccaacctctccgtccgtacgcctaacgtaccggaaccgacgcgtaacggtggtaccgttagggtttacgttaccgaaagttcgttcgttaaccgtccgtttaaccgaaccaccgaaccccgaaccngggacccaaccgtcccctaaaccccctaaaggtctaaccgtttaagtcgtttacgaggtaccgtacgtaaccgtagggccccgtccggtacgggccggttctacggtccttcgtcctaacgtcgtccggaccttacggaacccgtcgggtacgccacccggtaccccgtcgtttcccaagggttccccacggtttgcccgggttacctcggacggtacgagggtaccgagtcgtacggtntagtaaacgtttcgtaacgttctacgttactacgtacgttacgacgtacggaccgttaccggcttacggttcggttacgggtcgttcgggacggttaacgccggtaggacccgtacgttaccggtcccgaaggttacccgacgtcccggaaccgggtccctccgggtcccgtagtaccctcgttcccgtaccccg

SEQ ID NO: 105847 - DNA, 797 bp, Homo sapiens
  misc_feature: GYAE6OF01BJUC1.22.21.B10.1.454.CMB.1.raw
  modified_base (607)..(607): a, c, t, g, unknown or other
  misc_feature (607)..(607): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcacgcctcctcactcagggcacaggggtcctcgggcccaggtcctcgcctgactcacgcctccctccgcggtccgggtctccgtggacagtcacgtcaccattctcctgcacgtacggaaccagcctaggttacggacggtttggtacggttacaagttagtcgttcctccgtacggtaaccaaacacccgaaccgacggtaccaaccgaaccgaccccaaaactcgaactacgttattttaacgacgggtaacgtaccaaacggtacggaccgggtcccgtacgggtacggggttaccctaggtacgttcctccgtttcgtccggttcggaccttacggacgttccggacggacggtaaccggccggtacccttcccgacggttaccccgttcgtccgggtcggtccgtaccgggaggtccggtacggaacggcggttacgggaccgtgtacgttacgtttacttacgtacgttacctattactaacgtttacnccggacgggtacgggacggttacgttaccggtttcgggtttcggggttacggtcggggggtaacccggtacggggaaccttacgggtacgtccgggttaaccggttccggtacggtaaccgaaccgggaccgttaccggtaccggttcccggacccgtttaccggtaccttcccgttccggtttaccccg

SEQ ID NO: 105848 - DNA, 787 bp, Homo sapiens
  misc_feature: GYAE6OF01BJG1V.22.21.B10.1.454.CMB.1.raw
  modified_base (235)..(235): a, c, t, g, unknown or other
  misc_feature (235)..(235): n is a, c, g, or t
tcagacatacgcgtcacgaccggtgctcgatttagtgtcgtcgcaaggggggggtctcgaggaggcagcgctctcaggacgtcaccaccatggcctgggctctgctcctcctcagccctacctcactcgagggcacgagggtcctgggcccagtctcgtccctgactcacgtccctcctcggcgtccggtctccgtggactagtcagtcacctatcctctgcacgtacggaaccnggtacagtgtacgttggtaacgttaacaagtcgtgtcctaccgtacggaaccctaacaacccaccgaggaccaaccgaaccgtacccccaaaagtcacgtagtaattagtcggaacgtacgaacgtaacggccggtaccgtacggacgggttccctaggtaccgttaccgtcgttaccgtcgtacggtaccttaacgaacggttccggacggacccggtaaccgtaacccggcccttacccgtacggtaacccgttcgaccggttacggtaccgtaccgaggtaccgtagggaacgtagtacggtacgtatacgttaaacttaccgtacggtactacttaccgtacgtagtacgtggaaccggtcggtacccgtaacggtacggtttcgggttacggggttacgttaccggggacgggtaaacgtaacgtacggtaccgtaacccggttaacggtaccggtaccggaaccgtaaccggaccccggtaaacggttccccgtacccggtacccccggttaagggacccttcccggtacccggtttaaccccccg

SEQ ID NO: 105849 - DNA, 756 bp, Homo sapiens
  misc_feature: GYAE6OF01EGG76.22.21.B10.1.454.CMB.1.raw
  modified_base (231)..(231): a, c, t, g, unknown or other
  misc_feature (231)..(231): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtccgtcgggcccagtctcgccctgactcacgcctccctccgcgtccgggtctccgtggacagtcacgtccaccatctcctgcactcggaaccngctagtcgtacggttggtaggttaacaagtactcgtctccgtacggtaaccaacgaccaccgacggccaacgaccgaccccaaactcattacgtatttagcggtacgtacacgtacggccggtcctacggtacgggtcctaggtacgtccgtctttcctcggtaccggccttaaccgtaaggttccggtcgggaccgtaacccgtaccggtcccctttacccgtacgggttacccgtcgttaccgggtcgggtaccgtccgggtacggtacggtaacgggtacggtaacggtgggtaccgtacggttaagtttacgtttacttacgttacgtaccttacgtacttacgtacgtgaacggtacggacggtaccttacggtttcgggtttcgggttacggtaccggggacgggtaacgggtaacgtacggtaccgttaccgggtaccgttccggtacggtaccgtacgacccggaccgttacccggtcccgttaccccggtacggtcccttacgtcccgtttacccg

SEQ ID NO: 105850 - DNA, 814 bp, Homo sapiens
  misc_feature: GYAE6OF01EE1U5.22.21.B10.1.454.CMB.1.raw
  modified_base (308)..(308): a, c, t, g, unknown or other
  misc_feature (308)..(308): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctgggcccagtctgccctgactcagcctccctcgcgtccgggtctcctggacagtcagtcaccatcctcctgcacgtacggaaaccagcagtcgtacggttggtagttaacaagtatgtctccgtggtaccaacaccaccagcacacgaccccaaatcatgtatttagngacgtcacgtaacggcggcctcgacgggtccctagacgtcgtcttcgtcgtacggtcctaccgtaaggttcgtacgggaccgtaaccgtacccgggtccccttacccgtacgggtaaccccgttcgttccgggttaccggggtacccttacccggaacggggttccgttaacggggtaacgggtacggttcgggaaacggtccgtttaagggttaactttttaacggtttaccgttacggtacctttaaccgttactaaagtttacgtacgggaccggtaacggggtacccggttaaccttaccgggtttcgggttttacgggggttcccgggttaccgggggaaccgggtaaccgggtaaccgtaacgggtcccgttaacccgggtaacccggtttccgggtaaccggtacccggtaacccggtaaccccgggtaagggtcccccgtttcccggtacccccccggttagggttacccttacccgttccgttttaacccccccggg

SEQ ID NO: 105851 - DNA, 672 bp, Homo sapiens
  misc_feature: GYAE6OF01A6NSB.22.21.B10.1.454.CMB.1.raw
  modified_base (247)..(247): a, c, t, g, unknown or other
  misc_feature (247)..(247): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatcctcctgcactggaaccagcagtgacgttggtgttacagtntgtctctgtaccaacaccaccaggcacacgccccaactcatgatttatgacgtcacgtagcggcctcgacgggtcctgatcgcttctcgtacggtctaccgaagtcgtcggccgacgaccggtccctcccgtcgtaccgttccgtcgtcgggtcctaccgaggtctacggacggtagtggacggtcttaggtaactttacgttacgttcgtacctttaaccgtctaacgttactcggacgtacgggaccggtaccgtaaccgtttccgggtttaggggttccgggttaccgggacggggaacgggtacccgtaacggttccgtacggttaccccggtccggttaacgggtaccgaccggtacccgtaacgggtccccgtaccggtccccccgttacgggtaccctaccgttccggttccccccgg

SEQ ID NO: 105852 - DNA, 833 bp, Homo sapiens
  misc_feature: GYAE6OF01AJ7LG.22.21.B10.1.454.CMB.1.raw
  modified_base (222)..(222): a, c, t, g, unknown or other
  misc_feature (222)..(222): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacgacggtcctggcccagtctcgccctgactcagcctccctccgcgtccggtctcctggacagtcacgtccacactctcctgcacgtggaccngcagtgacgttggtcgtacagtactcgtccgtccgtacggtacccaacacccaccgaggcctacgtacccgtacccccgtaaaactcgtaacgttcgtaacgttttacgtacggtacggttaacccgtaacggtaaccgggaccggtcccgttccgggtaaaccggggttccctacggtaccgtcgttccgttcccgttcgtcgaccgtttaccggtaaacgtccggttccggacccgtaccggtaacccgtccgttaccccgtaccgtacccggttccgttccggtccgggtaccctaccggtaccggtacgtacggtacggtacggtacgacggtcgttaacgttaacgttcgttaccgtcgtaccgttaccgtacgtacgtacgtccggaacggtccgggtaccgttaccgttacccgggttggttaccggggttcggtttacccgggaccggggtaaaccgggtaccgtacggttaccgggttccccgtaacccgggttccggttaacccggtaccggttaccccgtaacccgggttaaccggtccccggttaccccggtaccccggttcccgggtaacccttcccggtttcccgtttaccccccgg

SEQ ID NO: 105853 - DNA, 852 bp, Homo sapiens
  misc_feature: GYAE6OF01ASETQ.22.21.B10.1.454.CMB.1.raw
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (651)..(651): a, c, t, g, unknown or other
  misc_feature (651)..(651): n is a, c, g, or t
tcagacatacgcgtcacgaccggtgctcgatttagtgtcgtcgcaagggggggggtctcaggaggcagcgctctcaggacgtcaccaccatggcctgggctctgcctcctcctcagcctcctcactcgagggcacgagggtcctgggccctagtcttcgtcctgactcacgtccctcccgtccgtccggttccgggtctacccgtggactacgtcacgtccacnttacctcctgacctacgtacggaaccngacgtaggtagtacgggttaggtcggttaacaagttctacggttctccgtaacgtaaccaaccgacccaccgaggcctaaccgcccggaaccccctaaatctaagttacgttacttagccggtacggtaccacggtacggaccggtcccgtaacggtcgggtacctgtacccggttccgttccctttacggtccggtacgtaccccgttactaacccgggttggtacccggtaaccggacccgttaaccccggtccccgtaccggtacccggttacccggtacccggttcggggtaccgtcccggtaaccggcgggttaaacgtagggtaacggcggttaaccgggtacgttcgttaagttttaaaccgttcgttaacccgtcttaccggtactaacgtntacgggtaccggcggtaaccggtacgtaccgtaccgggttagggtttcgggtaccggggttacgggaccgggtaacggtaacgttaaccggtccgtaccgggttaaccggttcgggtacacccggtccgggtaaacccgtcccgggaccttcccccggggtcccgttacccgtacctttcccgtcccgtttaacccccccg

SEQ ID NO: 105854 - DNA, 700 bp, Homo sapiens
  misc_feature: GYAE6OF01EKEY0.22.21.B10.1.454.CMB.1.raw
  modified_base (134)..(134): a, c, t, g, unknown or other
  misc_feature (134)..(134): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
tcagacatacgcgtcacgaccggtgctcgatttagtgtcgtcgcaaggggggggtctcaggaggcagcgctctcaggacgtcaccaccagtggcctgggctctgctcctcctcagcctcctcactcagggcacngggtcctgggcccagtctgccctgactcagccctccctcgcgtccggtctccgtggacagtcagtcacntctctgcactgaaccngcagtgacgtttggagttacaagtntcgtcctcgtcgaaccaaccacccaccgaggccacaccgacccccaaactcattgtaatttacgtgtacggtaccaacgtaggccggccgtacggtacgggtccctgacgtcgtcttctcgtcggacctccgtaagtccgtggccgtaaccgaccggcccttcccgtcggtacccgttccgtacggtcgggtcctaccggaggtcgtaggacggtagttacggacggttcttaaggtactttacgttcgtcgtaccttactactacgtgcggtacgacggtaccgtaacgttaccggtttacgggttcgggttacgggtaccgggtacgggtaacgaccgtaaccggtccgtaaccgggttacccggttaccgttacggacccgtaccggaaccccggtacggtccccgttaccccggtcccccgttacgtcccgtaccgttccccgttacccccg

SEQ ID NO: 105855 - DNA, 830 bp, Homo sapiens
  misc_feature: GYAE6OF01EDDQB.22.21.B10.1.454.CMB.1.raw
  modified_base (237)..(237): a, c, t, g, unknown or other
  misc_feature (237)..(237): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctcgccctgactcagcctccctccgccgtccgggtctccgtggactacgtcacgtccacctatcctccgtgcctacgtacggaaccncgacaggttcgtacggtttggtacggttaactaagttagttcgttcctaccgtacggtaaaccccaaaccaccccgaacccgtaacggacccaaccaacccgacccccctaaaacttcgaactttagttaacgttttaggtacggtacggtaaccgtaaacggttaaacggggcccggtacccgttaaccgggaccggggtttccccaggtaccgttcggttccttaccgttcgtcggttaccgtaacgtacgtccggtacggcccggtaaacgtcccggtccccttacccgcggttaccccgttcgttccggtccgggtacccgtaccggtacggtcgacgggtaggtacgtaggacggtacgtttacgttaactttacgttaccgtacttacctttaaccgtcttaagttacgcggtaccggcggtaccgtaaccgttaccggtttcgggttgggttacggttaccggggacgggtaaccggaacgtccggtccgtaccgggttacccgtcggtaccgcggttaacccggacccgtacggtccccgttacccggtccccgttacgggtcccttaccgttcccggtcccccg

SEQ ID NO: 105856 - DNA, 708 bp, Homo sapiens
  misc_feature: GYAE6OF01BC4S6.22.21.B10.1.454.CMB.1.raw
  modified_base (194)..(194): a, c, t, g, unknown or other
  misc_feature (194)..(194): n is a, c, g, or t
  modified_base (227)..(227): a, c, t, g, unknown or other
  misc_feature (227)..(227): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcgagggcacagggtcctgggcccagtctgccctgactcagcctccctccgcgtccgggtctccgtggacngtcagtccaccatctcctgccacgtcggaaccngcagtcgacgttggtaggttacaagttatcgtcctccgtaggtaaccaacacccaccgagccacaccgaccccaaatcatacgtatttagaggtacgtacacgtaacggccggcctcgtacgggtcctagacttcgtccttcgtccgtcgtcctacccaaggtccgtcggaccaccgaccggtccctccgtacgtaccgtctcggtcggcctcgngtccgtgacgntacggagcgtagtacttacgtactcgacttacgtataagtacgtaggtcgacgggtcctaaccgtaccgtttcgggtttcggggttaacgggttcccgggacggggtaaaccggtacccgaaacgggtcccgttaccgggtaaccccggttaccgttaagggtcccggaaacccgggttccccgtaaacgggtcccctttaccccgggaccccccgtttacggtaacccttccggtttcccccgttaacccccgg

SEQ ID NO: 105857 - DNA, 659 bp, Homo sapiens
  misc_feature: GYAE6OF01AYOJA.22.21.B10.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (486)..(486): a, c, t, g, unknown or other
  misc_feature (486)..(486): n is a, c, g, or t
tcagacatacgcgtcacgaccggtgctcgatttagtgtcgtcgcaagggggggggtctcgaggaggcagcgctctcaggacgtcaccaccatcggcctgggctctgctcctccgtcagcctcctcactcagggcacaggggtcctgggcccagtctcgccctgactcagccctcctccgccgtccgggtctccgtggacngtcagtccacatcgtcctgccacgtggaaccngcagtcgcgttgtggtacagtntcgtctctcggacctaacaccaccgaggcacgacgaccccctaaacgtccatcgtactttagtgacgtaccaacgtacggccggcctcggacggggttccctggtactccgtcttcgtcgtcgtacctccgtaagtccgtacggccgaccgaccggtcccgtcccgtaccgtacccgttccgtccggtcggtcccgtccgacggtcgtaggcggtaggtacggacggtcgtntaacgtttacgtacgttcgtaccttacgttcctaagtactacggtacggtacggtaccggtaactaccgttcggtttacggggtcgttacgggacgggtaacgacgtacgccgtcggtaccggtcgtacggtcgccgtaccgagtcccgtccacccggtgctcgtcgttcccg

SEQ ID NO: 105858 - DNA, 668 bp, Homo sapiens
  misc_feature: GYAE6OF01A1KFZ.22.21.B10.1.454.CMB.1.raw
  modified_base (250)..(250): a, c, t, g, unknown or other
  misc_feature (250)..(250): n is a, c, g, or t
  modified_base (467)..(467): a, c, t, g, unknown or other
  misc_feature (467)..(467): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctctggacagtcagtccaccatctcctgccacgtcggaaccagcaggtagtcggttggtgtaacagtntcgtcctcgtacgaccaaccacccgaccgagaccacacccgaaccccaatcagtactatttagcggtacgtacaacgtacgggccggttcctaccggtacgggttccagtcgtccgttcttcgttcgtccgcctaccgtagtcggtcggaccgacgacccgtccctccgtacgtaccgttcgtccggtcggtccaccggtgacgttagggacgtagnggtcgtcgttattacgttnttacncgtactacgtnaacgtgcggacgccgggacgtaacgttacgttggggttacgggtcggtaccgggacgggtaacggtaaccgagttaccggccgttacccgtacggtaccgaccgaccggacccgaaccggttccgtccccggttaccgtacccgtacttcccgtccggttcccccg

SEQ ID NO: 105859 - DNA, 714 bp, Homo sapiens
  misc_feature: GYAE6OF01D6TFY.22.21.B10.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
tcagacatacgcgtcacgaccggtgctcgatttagtgtcgtcgcaaggggggggtctcaggaggcagcgctctcaggacgtcaccacatggcctggctctgctcctcctcacgcctcctcactcgagggcacgcgggtcctgggcccagtctcgccctgactcacgtccctcccgtcgcggttccggtctcgtggactagtcagtcactactctcctgctacgcggaaccngcagtgacgttggtagtacaagtntcgtctacgtcgtaccaacaccacgacgcactaccacccaatcatntatttacgagtacgtaccacgtacggcggtcctacggtacggtctgtactcgttctcncgtcacctacgagtcgacgtacgaccgtaccgtccctccgtacggtccgttcgtcggtcggtcctacggtcggtctacgggagtacggtacggaggttcgttagttattaacgtttactacgttaccgttacctacgtacgttacggcgacgggtaccggtcggtaacgttacccgggttttcggggttacggggttacgggttccggggacgggaacccgggttacggtaccggttacccggtaccggttaaccggtacgggtttaccggacccggacccggttcccggaacccggttcccgttaccccggtccccgttaccggttcccttaaccggttccccggttaccccgg

SEQ ID NO: 105860 - DNA, 498 bp, Homo sapiens
  misc_feature: GYAE6OF02G7T0W.22.21.B10.1.454.CMB.1.raw
  modified_base (494)..(494): a, c, t, g, unknown or other
  misc_feature (494)..(494): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgagctgattatactgctactcatatgcaggcgcaactcgttgggtgttcggcggaggaccaagctgaccgtctaggtcacgccagctcgccctgcactntccg

SEQ ID NO: 105861 - DNA, 499 bp, Homo sapiens
  misc_feature: GYAE6OF02G31U3.22.21.B10.1.454.CMB.1.raw
  modified_base (293)..(293): a, c, t, g, unknown or other
  misc_feature (293)..(293): n is a, c, g, or t
  modified_base (409)..(409): a, c, t, g, unknown or other
  misc_feature (409)..(409): n is a, c, g, or t
tcagacatacgcgtcacgaccggtgctcgatttagtgtcgtcgcaagggggtctcaggaggcagcgctctcaggacgtcaccaccatggcctgggctctgctcctcctcagcctcctcactcagggcacagggtcctgggcccagtctgtcctgactcagcctccctccgcgtccgggtctcctggacagtcagtcaccatctcctgcactggaaccagcagtgacgttggtggttacaagtatgtctcctggtaccaacaccaccaggcacagcccccaaatcatgatttangagtcactaagcggcctcaggggtccctgatcgcttctctggctccaagtctggcacacggcctcctgaccgtctctgggctccgaggctgagatgagctgattatactgctactnatatgcaggcgctaactcgttgggtgttcgggcggaggaccaagcgtgaccgtctaggtcagcccaaggctcggcccctggtcactctcg

SEQ ID NO: 105862 - DNA, 508 bp, Homo sapiens
  misc_feature: GYAE6OF02JXYB7.22.21.B10.1.454.CMB.1.raw
  modified_base (239)..(239): a, c, t, g, unknown or other
  misc_feature (239)..(239): n is a, c, g, or t
  modified_base (295)..(295): a, c, t, g, unknown or other
  misc_feature (295)..(295): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttanaactatgtctcctggtaccaacaacacccaggcaaagcccccaaatcatgatttangaggtcactaagcggcctcaggggtccctgatcgcttctctggctcaagtctggcaacacggcctcctgaccgtctcgtgggcctccaggctgaggatgaggctgattattacgngcagctcatntggagcagcgtanaagtttggtgttcggcggagggaccaagctaggaccgtctaggtcacgccgaagctcgcccctggtcactctccg

SEQ ID NO: 105863 - DNA, 609 bp, Homo sapiens
  misc_feature: GYAE6OF02I5DEG.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctctggtaccaacaccaccaggcacacgcccccaaactcatgatttatgaggtcacgtaagcggcctcgacggggtccctgactcgcttctcgtcggcctaccgaagttccgtgggccgaccgaccgggtccccttcccgtcggacccgttcgttccgtcgggcctcccgacggtctggaggagtggaggtctagtattacgttactgtaccttactctaattatcggcgaggccggactaacgtttcggttggggttcgtttcggggacggtacgggaccaaggtccgtacggacccgtcggtaggtcgaccgtcccgaaggtcctaccggtcccccgtcgggtcctaccgtcgttcccg

SEQ ID NO: 105864 - DNA, 519 bp, Homo sapiens
  misc_feature: GYAE6OF02GLU1U.22.21.B10.1.454.CMB.1.raw
  modified_base (398)..(398): a, c, t, g, unknown or other
  misc_feature (398)..(398): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaatcatgatttatgaggtcactaagcgggcctcgaggggtccctgatcgcttctctggctccaagtctggcgacacggcctccctgacccgtctctgggctccgaggctggaggntggaggctgattattactgcttactcatatgcaggcgacaacgtcgttgggtgttcggcggagggaccaaggctcgaccgtctaggtcacgcccaaggctcgcccctggtccacgtctccg

SEQ ID NO: 105865 - DNA, 558 bp, Homo sapiens
  misc_feature: GYAE6OF02H2PHV.22.21.B10.1.454.CMB.1.raw
  modified_base (300)..(300): a, c, t, g, unknown or other
  misc_feature (300)..(300): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacacgaccccccaaatcaatgatttangagtcactaagcggcctcgagggtccctgatcgcttctctggctccagtctggcacacggccctccctgacccgtctcgtcgggcctccgaggctggaggatggaggctagtatttattactgcttactcatatgcgagggcgactaacgttcgttaggggttgttcgggcggacgggaccaggtcctcggacccggtcgtacggtcacggtaccccgaggtcctccggcccccgttcgggtcctaccgttcttcccg

SEQ ID NO: 105866 - DNA, 507 bp, Homo sapiens
  misc_feature: GYAE6OF02HPBAU.22.21.B10.1.454.CMB.1.raw
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattatactgctgctcatttgcaggcgcctacacttgggtgttcggcggagggaccagctgaccgtctaggtcagcccaaggctcgcccctcggtccactctccg

SEQ ID NO: 105867 - DNA, 574 bp, Homo sapiens
  misc_feature: GYAE6OF02IX9BJ.22.21.B10.1.454.CMB.1.raw
  modified_base (234)..(234): a, c, t, g, unknown or other
  misc_feature (234)..(234): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggngttacaagtatgtctctggtaccaacaccacccaggcacacgcccccaaactcatcgatttatgaggtcacgtaagcgggcctcgaggggtccctgatcgcttcnctggctccaatcngcgacacggcctccctgacccgtctcgtgggctccgaggctgaggatggagtctagtacttattactgcttactactactatgcgaaggccggtactaaccgttcgtttacggggtcgtttcgggccggtaagggaccaacgtcgtacggaccggtcctaagggtccacgacccgaaggtcctaccggcccccgttcgggtacctaccgttccgttaccccg

SEQ ID NO: 105868 - DNA, 522 bp, Homo sapiens
  misc_feature: GYAE6OF02JDFF0.22.21.B10.1.454.CMB.1.raw
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaacgcccccaaactcatgatttangaggtcactaagcggccctcgacggggtccctgactcgcttctctggctcaagtctggcaacacggcctccctgacccgtctcgtgggcctccgaggctgaggatgaggctgattattcngcagctcatatgggagcagcgacttaagtttgggcgttcggcggaggaccagctgaccgtcgtaggcacgcccgaaggcctccgccccttggtccactcctccg

SEQ ID NO: 105869 - DNA, 508 bp, Homo sapiens
  misc_feature: GYAE6OF02GX3XF.22.21.B10.1.454.CMB.1.raw
  modified_base (298)..(298): a, c, t, g, unknown or other
  misc_feature (298)..(298): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacacgcccccaaactcatgatttangaggtcactaagcgcctcgagggtccctgatcgcttctctggctccaagtctggcacacggcctccctgaccgtctcgtcgggcctccgaggctggaggatggaggctgattattactgctactcatatgcaggcgcactcgttgggtgttcggcggaggaccagctgaccgtctaggtcacgccaggctcgccccgtcgtcactctccg

SEQ ID NO: 105870 - DNA, 528 bp, Homo sapiens
  misc_feature: GYAE6OF02FW7ZZ.22.21.B10.1.454.CMB.1.raw
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccaccaggcacagcccccaaatcatgatttangaggtcactaagcggcctcgagggtccctgatcgcttctctggctccaagtctggcgacacggcctccctgacccgtctcgtgggcctccgaggctggaggatggaggctgtattattactgcttactcatatgcaggcgcaacgttcgttgggtgttcggcggagggaccagctcgaccgtcgtaggtccacgcccgaggcctcggcccccgtggtcctaccgtcttcccg

SEQ ID NO: 105871 - DNA, 640 bp, Homo sapiens
  misc_feature: GYAE6OF02IDUMN.22.21.B10.1.454.CMB.1.raw
  modified_base (301)..(301): a, c, t, g, unknown or other
  misc_feature (301)..(301): n is a, c, g, or t
tcagacatacgcgtcacgaccggtgctcgatttagtgtcgtcgcaaggggggtcgtcgaggaggcgagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcatggaaccagcagtgacgttggtggttacaagtatgtctcctggtaccaacaccaccaaggccacacgcccccaaaatcatgacttttangaggtcaactaagcggctacgagggtcctgatcgtcttctctcggcttccgaagtctggcgaacacggcccttccgtagtaccgtcctcgtcgggccttccgacggctacggtacggacttcggaacggtctaggtactttaacgttacgtcgttactacttaccgaattatcggtacacgggacggactaacgttcgtttcgggggttcttccggggacggtacggggaaccgtaacgtcgtacgggtacccgttaccggtaacgggttccaacggtaccccggtaaaggtcccgtacggtccccccgttaacgggtctacccgtccgtttaccccgg

SEQ ID NO: 105872 - DNA, 510 bp, Homo sapiens
  misc_feature: GYAE6OF02GFUUK.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccaccaggcacacgcccccaaactcatgattatgagtcactaagcggcctcgagggtccctgatcgcttctctgctccaagtctggcgacacggcctccctgaccgtctctgggcctccgaggctgaggatgaggctgattattactgctactcatatgcaggcgactaacgtcgttgggtgttcggcggaggaccagctgaccgtctaggtcacgccgaagctcgcccctcggtctactctcccg

SEQ ID NO: 105873 - DNA, 509 bp, Homo sapiens
  misc_feature: GYAE6OF02ILFZ2.22.21.B10.1.454.CMB.1.raw
  modified_base (335)..(335): a, c, t, g, unknown or other
  misc_feature (335)..(335): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaatcatgatttatgaggtcactaagcggccctcagggtccctgatcgcttcnctggctcaagtctggcaacacggcctccctgaccgtctctgggctccaggctgagatgagctgattattactgcagctcatagtggaggcagcgactaagtttggtgttcggcggagggaccagctcgacgtcctaggtcagcccgaaggcctcgccccctcggtccacgtccg

SEQ ID NO: 105874 - DNA, 506 bp, Homo sapiens
  misc_feature: GYAE6OF02F7RXI.22.21.B10.1.454.CMB.1.raw
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgacccagcctccctccgcgtccgggtctcctggacagtcagtcaccatctcctgcactggaaccagcagtgacgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctggctccaggctgaagatgaggctgattatactgctgctcatttgcaggcgcctacacgttgggtgttcggcggaggaccagcgtgaccgtcctaggtcacgcccaaggcctcgccccctcggtctaccg

SEQ ID NO: 105875 - DNA, 531 bp, Homo sapiens
  misc_feature: GYAE6OF02JK0AN.22.21.B10.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
  modified_base (501)..(501): a, c, t, g, unknown or other
  misc_feature (501)..(501): n is a, c, g, or t
tcagacatacgcgtcacgaccggtgctcgatttagtgtcgtcgcaaggggggtcgtcgaggaggcagcgctctcaggacgtcaccaccatggcctgggctctgctcctcctcagcctcctcactccagggcacagggtcctgggcccagtctgccctgactcagcctcctccgcgtccgggtctcctggacagtcagtcaccatcncctgcactggaaccagcagtgacgttggtggttacaaagtntgtcctctggtaccaacaccaccaggcacagccccccaaaactcatgatttatgaggtcacgtaagcgggcctcgagggtccctgatcgcttcnctcggctccaagtctggcgacacgcctcctgaccgtctcgnggcctccgagctgagntggagctgattattcngctactcatatgctggcgctaacgttcgttggtcgttcggacggaggaccagtctacggccgttccgtaggcacgacccgaggtccnccggtccccctggtccctacgtccgttccg

SEQ ID NO: 105876 - DNA, 579 bp, Homo sapiens
  misc_feature: GYAE6OF02I8DI4.22.21.B10.1.454.CMB.1.raw
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcaccatctcctgcactggaaccagcagtgacgttggtggttacaagtatgtctcctggtaccaacaccacccaggcaccagcccccaaatcatgatttangaggtcataagcggcctcgagggtccctgatcgcttcnctgctcagtctggcgacacggcctccgtgaccgtctcgtgggcctccgaggcctggacggagtggagcgtagtattattacgtgtactactcatagtcgcgacgggcggactaacgttcggttcgggttggtttccgggacgggtacgggacctaaggcgtacggtacccggtccgttacggtccgaccggacccgaacgggccttaccggccccccgttccggtcctaccgtccgttacccg

SEQ ID NO: 105877 - DNA, 627 bp, Homo sapiens
  misc_feature: GYAE6OF02HVHI0.22.21.B10.1.454.CMB.1.raw
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctcctgcactggaaccagcagtgacgttggtggttacaagtatgtctctcggtacaacaccaccagcacacgaccccaatcatgtattangtagtacacgtagccggcctcgacgggtcctgatcgcttctcgtcggctccaagtctggcgacgacggcctcccgtgacccgtctcgtcgggtcctcgaggtctaggagggactgggagtcgtagtactttattaacgtcgtaccttactactaatagtcgtacgaacgggccggtaacaaccgtttcgttcggggttcgggttaccgggacggggaacgggtaccgaacggtacgttccggtaacccggtccgttaaccgggtaccacggttaaccccgaagggtcccttcccggacccccgttacgggtccctaccggttccttacccccgg

SEQ ID NO: 105878 - DNA, 541 bp, Homo sapiens
  misc_feature: GYAE6OF02GGRWW.22.21.B10.1.454.CMB.1.raw
  modified_base (431)..(431): a, c, t, g, unknown or other
  misc_feature (431)..(431): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccaccaggcacacgcccccaaactcatgatttatgaggtcactaaggcgggcctcgacggggtccctgatcgcttctctggctcaagtctggcgacacggcctccctgaccgtctccgtgggcctccgaggctggaggatggaggctgattatactgcttactcatntgcgaggcgactacgtcgttgggtcgttcgggaggacgggaccaagtcgtacgtaccgtcgtacggtcacgtacccgaggtcctcggcccctcggtcctacgtcgttccg

SEQ ID NO: 105879 - DNA, 584 bp, Homo sapiens
  misc_feature: GYAE6OF02IR2WP.22.21.B10.1.454.CMB.1.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctcctggtaccaacaccaccaggcacagcccccaaatcatgatttangaggtcactaagcggcctcgagggtccctgatcgcttctcncggctccaagtctggcgacacggcctcccgtgacccgttctcgtcgggctccgaggtctggacggagtggacggtcgtagtattacgttacgtgtcttactctatatggcgagggcgacgtaacttcggttaggggttcgttcgggacgggaacgggacccgaaggtcgtacggtacccggttaccgtacgggtcgaacggtacccgaagggtcctccggcccccgtcggtcctaccgtcttacccgg

SEQ ID NO: 105880 - DNA, 628 bp, Homo sapiens
  misc_feature: GYAE6OF02HFWAE.22.21.B10.1.454.CMB.1.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctggtaccaacaccaccagcacacgcccccaaatcatgatttangagtcactaagcgccctcgacgggtccctgactcgtcttctctggctcaagtctggacaacncggcctcctcgaccgtctcgtcgggcctccgacggctaggaggtagtggaggtcttagtaactttagttacgtcgactacgtctacaagttagtgggacggtaccaggtaccgtaagttaacggttttgggtcgggttacgggacggggtaacgggtaaccgaggtaccgtaccgggtacccggttaccggttagggtcccgtaaccggacccgtaacgggtcccgttacccggtaccccccgttcgggttaccctacccgtttaccccgg

SEQ ID NO: 105881 - DNA, 523 bp, Homo sapiens
  misc_feature: GYAE6OF02FU4IU.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggccctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaatcatgatttatgaggtcactaagcgggcctcgaggggtccctgatcgcttctctggctccaagtctggcgacacggcctccctgacccgtctcgtgggctccgaggctgaggatgaggctgattatactgctactcatatgcaggcgcaactcgttgggtgttcggcggaggaccaagctagaccgtcgtaggtcacgcccgaaggcctcgccccgtcgtccacttcgtcgtccccg

SEQ ID NO: 105882 - DNA, 603 bp, Homo sapiens
  misc_feature: GYAE6OF02IITXH.22.21.B10.1.454.CMB.1.raw
  modified_base (244)..(244): a, c, t, g, unknown or other
  misc_feature (244)..(244): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctcctggtaccaacaccaccaggcacagccccaaactcatgatttatgaggtcactaagcgggcctcacgggtccctgactcgcttctctggctccaagtctggcgacaccggtcctcccgtcgacccgtctccgtcgggtcctccgacggcctgaggagtggacggctggtaactttagttacgtcgtactacctactatatcgacacgggtccggtactaaccgttcggtttgggtcgtttccgggacgggtaacgggaccctaaggtcctacggtacccggtccgtaacgggttccacggtacccgaagggtccctaccgtcccccgtacggtacctaccgttccgttcccgg

SEQ ID NO: 105883 - DNA, 571 bp, Homo sapiens
  misc_feature: GYAE6OF02JEDJ6.22.21.B10.1.454.CMB.1.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
  modified_base (453)..(453): a, c, t, g, unknown or other
  misc_feature (453)..(453): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctcctggtaccaacaccaccaggcacacgacccccaaatcatgattangaggtcactaacgcggcctcgacggggtccctgactcgcttctctcggctccaagtctggcgacgacggtcctcccgtgtacccgtctcgtcgggtcctccgaggtctggacggtactggagtctaggtaattacgttactgtaccttactcattancgcacggcgtacgtaacgtcgttgggtcgttcggcggaacggtaccaggccgtcggtacccgtcgtacggtcaacgacccgaaggtcctccgtcccccgtaggtccacttcgtacccg

SEQ ID NO: 105884 - DNA, 558 bp, Homo sapiens
  misc_feature: GYAE6OF02HOXGU.22.21.B10.1.454.CMB.1.raw
  modified_base (295)..(295): a, c, t, g, unknown or other
  misc_feature (295)..(295): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctcctggtaccaacaccaccaggcacacgcccccaaatcatgatttangaggtcactaagcggcctcgacgggtccctgactcgcttctctggctcaagtctggacaacacggcctccctgacccgtctcgtcgggcctccgacggtcgtaggaggactggacggtctagtatttattactgtacctactcatatgcgaggccggactaacgttcgttgggtgttcgggacggagggaccaagcgtagacccgtcgtacggtcgacgtcccgaaggtcctccgccccgttcggtacctaccttccgtcccg

SEQ ID NO: 105885 - DNA, 507 bp, Homo sapiens
  misc_feature: GYAE6OF02H3GW7.22.21.B10.1.454.CMB.1.raw
  modified_base (359)..(359): a, c, t, g, unknown or other
  misc_feature (359)..(359): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtctgggtctcctggacagtcagtcaccatctcctgcactggaaccagcagtgacgttggtggttacaagtatgtctcctggtaccaacaccaccaggcacacgcccccaaatcatgatttatgagtcactaagcgggcctcgacggggtccctgactcgcttctcgtggctcagtctggcaacncgcctcctgaccgtctcgtggctcgaggctgagatgagctgtattattacgtgcagctcatagtggagcagacgactagtttggngttcggnggagacagcgtggaccgtcgtaggtcagaccgaggcctccgccccgtggtcctccg

SEQ ID NO: 105886 - DNA, 846 bp, Homo sapiens
  misc_feature: GYAE6OF02H6XOA.22.21.B10.1.454.CMB.1.raw
  modified_base (185)..(185): a, c, t, g, unknown or other
  misc_feature (185)..(185): n is a, c, g, or t
  modified_base (837)..(837): a, c, t, g, unknown or other
  misc_feature (837)..(837): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgacccagcctgcctccgtgtctggatcgntcgtagactagtacgatcgacgcttactttccgcgacctacggtacgggaaaccaaacgtacggtacgtaacttagggtttcggggttttcttttacggacctttcgttcgttccgttccggttaaccggtaaacccaaaaccaacccaaccccggaaaccggaaacccccccaaaaccccccctaactaacctaacttaccctttaaagttttacggttcgggttacctaaccttacccggtttacccggtccccgggttaccccttacgggaacgggttacccgtttccttaccgtaccgtaccgttcccgttcctttaccgttaccggacggtcccttaaccggtaacgttcggaccggaaccctaaccgtaccccggtaccccttaacccctaaacttaccttccgttacgggtccgggtccccttacggttaggttacgggaacggtacgttacgttacctttatttacgtccgtcgtacttaacgtttaactttaaagcggacctctacgttcgttcggtttcgggttcggacgggacgtaccgaacggtagttcccgaccgttccgtccggtaccgcggtaacccgtaggtcccgttaccccgccccggttcgacctcccgtttcccgttaccgttacccccccnccttacccg

SEQ ID NO: 105887 - DNA, 695 bp, Homo sapiens
  misc_feature: GYAE6OF02H1EH1.22.21.B10.1.454.CMB.1.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
tcagacatacgcgtcacgaccggtgctcgatttagtgtcgtcgcaaggggggggtctcaggaggcagcgctctcaggacgtcaccaccatggcctgggctctgttcctcctcagcctcctcactcagggcacagggtcctgggcccagtctgccctgactcagcctccctccgcgtccgggtctcctggacagtcagtccacatctcctgcactggaaccngcagtgacgttggtggttaacagtntgtctcgtgtaccacaccaccagcacacgaccccaaactcatgtacttagngtagtacaacgtacggccggtcctcggacggggtccctgacttccgtcttccgtcgtcggtcctaccgtaagtcgtacggccgaaccgaccggtcccttcccgtacgtacccgttccgttccggtcggggtcccttaccggacggtccgtaggtacgggtacgtcgggacggtctaggttaactttaacgtttaccgtacgtaccttaacctataacttcgtcgacgtacggggccgtacttaaccggttcggttaggggttccggttacgggccgggaaggaccgaaggtcccgtacgggtacccgttcggtaacgggaccaccggtacccgtaacggtccgttacccccggccccggtttccggacccgtacccttccggttcccccggtcccccg

SEQ ID NO: 105888 - DNA, 618 bp, Homo sapiens
  misc_feature: GYAE6OF02GTXXX.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctgtaccaacaccaccagcacacgcccccaaactcatgattatgagtcactaagcggtcctcgacgggtccctgactcgcttctcgtgcctcaagtctggcgacacggccctcctgacccgttctcgtcgggtcctccgaggccgtggaacggtagtggtacggcttaggtactttaagttacgttcgtaccttacctctattagtcgctacgggtcgaccgtaacgttcggtttggggttcgttcccggggaggtacgggaacctaacggtcgtacgtacccggttccgtaacggtaccgtacggaccccgaagggtccccgttaccgtaccccccgttcgggtacctaccgttccgtttcccccgg

SEQ ID NO: 105889 - DNA, 677 bp, Homo sapiens
  misc_feature: GYAE6OF02JDERP.22.21.B10.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (520)..(520): a, c, t, g, unknown or other
  misc_feature (520)..(520): n is a, c, g, or t
tcagacatacgcgtcacgaccggtgctcgatttagtgtcgtcgcaagggggggtcgtcaggaggcagcgctctcaggacgtcaccaccatggcctgggctctgctcctcctcagccctcctcactcgagggcacgagggtcctgggcccagtctcgccctgactcagccctccctccgcgtccggtctccgtggacagtcagtcaccatctcctgcactggaaccngcagtgacgttggtgttacagtntgtctctgtaccacaccaccagcacaccgaccccaactcagtagtatttacgngtacggtaccaacgtaaggccgggtacctcgtacggggttccctgtacgttccggtctttccgtcgtcggtcctaccgtaacgttccgtacgggtaccgaccgtaccgggtcccctacccgttaccggaccgttccgttcgtcggggtccctacccggtacggtccgttacggacggtaacggtcggacggtaccgttagttaacttacgttacgttntaccgttacttacgatacgtagaccgtaggccggtacctaacgtcgtttcgggtacgttcgggtacggtacgggacgaacggtcgtaccggtaccgtccgtacggtcgaccgaccgtaacggccgtaccgcccgtacggacctaccgtcgttacccg

SEQ ID NO: 105890 - DNA, 986 bp, Homo sapiens
  misc_feature: GYAE6OF02HT2FS.22.21.B10.1.454.CMB.1.raw
tcagacatacgcgtcacgaccggtgctcgatttagtgtcgtcgcaagggggggtcgtcagggaggcgagccgtctcctcgaggaccgtacgaccctacccagttgggccgtagggcctacgtggaccttcccgtacctccaaggcctcccgtacacctaccgaaggggtcaaacgtaggggggtcccttggggccccaggttcgtttcgtccccttggaccttacttaacggacccgttcccgttcccggacggttccggggttacctcccggttgggaaccaaggtttccgaaggttcctaacccgtaggggttccgttccctttagggaccccaacgttccggggtaaacccgggtaccgcgtaaaggttcgtacccggttttcgggttagggtttaaccaaaggtttaactccggttccttccggttacggtttaaccccaaaaccgttaacccgtaaccccgaaagggtcctaaaccgacggtaacccccccgttaaaagtcccgaagttacggtacttttaaccggtagggtaacgggtcctaaacggtaaggccgggtacccgtaccgaaacggggtcccttagacgtccggactttcggtacgttacggacctaaccgtaaagttcgtcgggaacaacgtccggtccttacccggacgggacccgttctccggtaaccggtccttacgaccggtacgtacgggaacggaacgtacggaagggtacctacggttaactttaacgttactacggaacctagtaccgttaacaagtaccggttagggacggaccgacggaaccggtaacgttacggttttacggtcggtttaccgggtaacggtacgggttaccgaacggtacggttaaccgggaaccgggttacccggtaacgggttaaccgttaaccgggtaaccggtaacgggttccgttaccccggttaaccccccgtttcgggttacccgttaccggttaacccggg

SEQ ID NO: 105891 - DNA, 599 bp, Homo sapiens
  misc_feature: GYAE6OF02HDVIZ.22.21.B10.1.454.CMB.1.raw
  modified_base (294)..(294): a, c, t, g, unknown or other
  misc_feature (294)..(294): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcacgtggaaccagcagtgacgttggtgttacaagtatgtctctgtaccaacaccaccagcacacgacccccaatcatgatttangaggtcactaagcggcctcgacgggtccctgactcgcttctcgtcggcctacctaagtcgtggccgacgaccggtccctcccgtcgtacccgtctcgtcgggcctccgacggtctggaggtagtggaggtctggtaatttagttacgtgtacttactcatacgtcgcgaggcgactaacgttcgttgggtcgttcgggacggacgggacctaggccgtacggtacccggttcgtacgggtaccaccggacccgaaggtcccgtcccggtacccccgttcgggtaccttaccgtccgttaccccgg

SEQ ID NO: 105892 - DNA, 572 bp, Homo sapiens
  misc_feature: GYAE6OF02GCTQN.22.21.B10.1.454.CMB.1.raw
  modified_base (298)..(298): a, c, t, g, unknown or other
  misc_feature (298)..(298): n is a, c, g, or t
  modified_base (430)..(430): a, c, t, g, unknown or other
  misc_feature (430)..(430): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccaccaggcacacgaccccaaactcatgatttangagtcacgtaagcggcctcgagggtcctgatcgcttctctggctaccagtctggcgacacggccctcccgtcgacccgtctcgtgggcctccgaggctggaggatggaggctagtattattactgcttactnatatgacgaggcgactacgttcgttgggtcgttcgggcggaacgggaccaaggtcgtacggacccgttcgtacggtaccgaccggtacccgaacgggtcctcccggtcccccgttaccggtcctaccgttccgttaccccgg

SEQ ID NO: 105893 - DNA, 588 bp, Homo sapiens
  misc_feature: GYAE6OF02FV5NY.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctcctggtaccaacaccaccaggcacacgacccccaaactcatgtatttactggaggtcaacgtaaggcgggtcctcgacggggtccctgactcgcttctctgctcagtctggcgacgacgcctcctcgaccgtctcgtcggctccgaggcgtgaggatggacggctagtatttattacgtgacttactctatatcgcgaggaccgtactaacgttcggttcgggttgttcgggcgggtacgggaccaggtccgtacggacccggttcggtacgggttaccacggtacccgaacggtccctcccggtacccccgttcggtaccctaccgttcccgttcccg

SEQ ID NO: 105894 - DNA, 623 bp, Homo sapiens
  misc_feature: GYAE6OF02G88AG.22.21.B10.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatctcctgcactggaaccngcagtgacgttggtgttaacaagtntgtctctggtaccaacaccaccagcacacgccccaaatcatgtatttangacggtcaacgtaaggccggcctcgacgggtccctgactcgcttctcgtgcctacaagtcgtggcacgacggtccctccgtgaccgtctcgtcggcctaccgagtcnggaggngtggagtcgtagtaacttacttacgttcgtcctactcgtaacttagtcgtacgacgggacgtacctaacgttcggttcggggttcgttccggggacggtaacgggaacctagggtcctacggtaacccggttccggtaaggttcccaaccgggtacccgaacggtcccgttacccggtcccccggttggtaccctaccgttcccgttccccgg

SEQ ID NO: 105895 - DNA, 521 bp, Homo sapiens
  misc_feature: GYAE6OF02JEXU1.22.21.B10.1.454.CMB.1.raw
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacaagtatgtctcctggtaccaacaccaccaggcacacgcccccaaatcatgatttangaggtcacgtaagccgggcctcgagggtccctgatcgcttctctggcctccaagtctggcgacacggcctcctgaccgtctcgtggcctcgaggctgaggatggagctagtattattactgctactnatngcaggcgactaacgttcgttgggtcgttcggcggaggaccaagcgtgacccgtcgtaggtcacgccaaggcctcggcccctggcctcgtctcccg

SEQ ID NO: 105896 - DNA, 658 bp, Homo sapiens
  misc_feature: GYAE6OF02GHHF5.22.21.B10.1.454.CMB.1.raw
  modified_base (297)..(297): a, c, t, g, unknown or other
  misc_feature (297)..(297): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctcctggtaccaacaccaccaggcacacgcccccaaactcatgatttangagtcactagcggctcgagggtccctgatcgcttctcgtcggctccaagtctggcgacacggccctcccgtgacccgttctccgtgggtcctccgacgggtctgggaaggtacgtggaggtcgtaggtactttaagttaccgttagtacttactacctagttactacgtcgacgggtaccggacgtaaacgtttcggtttagggggtttcggtttaccggggaccggggtaacggggaccgtaacgggtccgtaaccgggtacccggttccggttaacgggtacccgtaacggtaccccggtaaggtcccgttcccggtaccccccgttaccgggtaccctaccgttcccgtttaccccgg

SEQ ID NO: 105897 - DNA, 592 bp, Homo sapiens
  misc_feature: GYAE6OF02GF9KS.22.21.B10.1.454.CMB.1.raw
  modified_base (377)..(377): a, c, t, g, unknown or other
  misc_feature (377)..(377): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacacgaccccccaaactcatgatttatgaggtcaactaaggcgggcctcgacggggtccctgactcgcttctctggctccaagtctggcgacacggcctcccngaccgtctcgtgggcctccgaggctggaggatggaggtctggtattacgttacgtgccagtcctacgattagtgggaggcgagcgtaacttaagttttgggtagttcgggacggtaacggggaccaaggtccgtcgggaacccgttccggttaacggtaccgaacggcccgtaacgggccgttcccggtcccccgtcggttacccaccgttcccg

SEQ ID NO: 105898 - DNA, 689 bp, Homo sapiens
  misc_feature: GYAE6OF02JKCU3.22.21.B10.1.454.CMB.1.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (402)..(402): a, c, t, g, unknown or other
  misc_feature (402)..(402): n is a, c, g, or t
tcagacatacgcgtcacgaccggtgctcgatttagtgtcgtcgcaagggggggtcgtcgaggaggcgagcgctctcaggacgtcaccaccatggcctgggctctgctcctcctcacgcctcctcactcagggcacacgggtcctgggcccagtcgtgccctgactcagccctcctccgcgtccgggtctcctggaccagtcagtccaccatcctcctagcactggaaccagcagtgacgttggcgttacaagtngtcnctgacacacacacgcacacgacccaaactcatcgattacncgaggtacactaagcggaccngacgggtcctgactcgctctctacgctcaagtctcggcgacnccggtactcccgtacgccgtcgtccgtacggtcctaaccgngggtcctggtaggacgtcggcggtacgtcggtaagtttacttaacggtcgtacgttacctacgtaactttaaggcgtccggtaaggtccgggtaaaccgtaacctttccgggttttggggttaccgtttaccggggggtacccgaacgggggtaccctaaagggtcccggttaccgggtaacccggttccccgggtttaggacccggtaaccgttacccccggtaaagggtcccgttccccgaaccccgggtttcccggggtacctacccggttaccggttccccgg

SEQ ID NO: 105899 - DNA, 535 bp, Homo sapiens
  misc_feature: GYAE6OF02GQ8T0.22.21.B10.1.454.CMB.1.raw
  modified_base (295)..(295): a, c, t, g, unknown or other
  misc_feature (295)..(295): n is a, c, g, or t
  modified_base (392)..(392): a, c, t, g, unknown or other
  misc_feature (392)..(392): n is a, c, g, or t
  modified_base (444)..(444): a, c, t, g, unknown or other
  misc_feature (444)..(444): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccaccaggcacacgcccccaaatcatgatttangagtcactaaggcggcctcgacgggtccctgatcgcttctctggctccaagtctggcgacgacggcctccctgacctctctgggctccgagctgagntggagctgatttatactgcagcctacatagtggagcagcgataagtttgggngttcggacggagggaccaaggccttaggcccggtcgtaggccaacgaccccgaagggtccctccggtccccccgtggtacccaccgttccg

SEQ ID NO: 105900 - DNA, 580 bp, Homo sapiens
  misc_feature: GYAE6OF02HF1XP.22.21.B10.1.454.CMB.1.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacntctcctgcactggaaccagcagtgacgttggtgttacgaagtntgtctctcggtaccaaccacccaccgacgcaccacgacccccaaactcatatatttatggtagtcaactaagaccggtcctacgacgggtcctgtactcgtctacgtctggctaccgagtcgtgacgacgcggtcctcctcgtaccgtctcgtggtcctaccgcgtcgtggaggtagtcggacgtcttaggtattacgttacgtactctacttataatatcggtacgacgggtcgacctagttcgtttgggtacgttcgggacggacggtacaggtcgtcgtaccggtcgtagcgtaccgccgagctccggcccgttcggtcaccgttcgtcccg

SEQ ID NO: 105901 - DNA, 598 bp, Homo sapiens
  misc_feature: GYAE6OF02I5280.22.21.B10.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtggttacaagtntgtctcctgtaccacaccaccagcacacgccccaaactcatgatttangagtcacgtaggcggcctcgacgggtcctgactcgcttcnctgcctcagtcngcacgcgcctccgcgccgtctcgtcggtcctccgaggtctggaggtactggagtcgtagtattacttacgtcgtacttactcaattactacgacgtcggaccggtctaaccgttcggttgggttaccggtttcgggaccggtaacgggacctaacggtcgtacggtacccggttacggttacggtaccgaccggtacccgaaggtcccgtcccggtacccccgttacgggtacccttaccgtaccgttccccg

SEQ ID NO: 105902 - DNA, 742 bp, Homo sapiens
  misc_feature: GYAE6OF02IZV58.22.21.B10.1.454.CMB.1.raw
  modified_base (237)..(237): a, c, t, g, unknown or other
  misc_feature (237)..(237): n is a, c, g, or t
  modified_base (300)..(300): a, c, t, g, unknown or other
  misc_feature (300)..(300): n is a, c, g, or t
tcagacatacgcgtcacgaccggtgctcgatttagtgtcgtcgcaagggggggtcgtcgaggaggcgagcgctctcaggacgtcaccaccatggcctgggctctgctcctcctcagcctcctcactcagggcacagggtcctggcccagtctgccctgactcagcctccctccgcgtccgggtctcctggacagtcagtcaccatctcctgcactcggaaccagcagtgacgttggngttacaagtatgtctctggtaccaacaccaccagcacacgaccccaaactcatagtatttagngagtacaacgtaagcggtcctacgacgggtcctgagtccgcttcctctggaccttccaaggtcctacgggcccgaacgtacccggccccttcccgccggtacccgttcgttcccggtggggacccttccggaacggttcctacgggaaagggtacttcgggaacggttctacggtaatttttaaggttaccgttagccctttaaacgttccgtaatttaacgtcgggaccgaacggggtcccggtaacttaacccgggtttcggtttacgggggttcggtttacccggggacgggaacggggttaccaacggtccgttcggaaccccgggtttacggtaccgggttaccgaacccgggaccccgttaaacggggtcccgtttacccgggttcccccccgggttaacggtaccccgttacccgtttaccccgtttaccccggg

SEQ ID NO: 105903 - DNA, 652 bp, Homo sapiens
  misc_feature: GYAE6OF02G36V4.22.21.B10.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (311)..(311): a, c, t, g, unknown or other
  misc_feature (311)..(311): n is a, c, g, or t
  modified_base (466)..(466): a, c, t, g, unknown or other
  misc_feature (466)..(466): n is a, c, g, or t
  modified_base (512)..(512): a, c, t, g, unknown or other
  misc_feature (512)..(512): n is a, c, g, or t
tcagacatacgcgtcacgaccggtgctcgatttagtgtcgtcgcaagggggggtcgtcgaggaggcgagcgctctcaggacgtcaccaccatggcctggctctgctcctcctcagcctcctcactcagggcacagggtcctgggcccagtctgccctgactcacgccctccctccgcgtcccgggtctcctcggacagttcagtccaccatcctctgcactcgggaaccngcaagtcgacttggtagtacaagtntcgtctcctgtacaactaccacaggccacacgtacccccaaatcaatcgtaatttntacgaggtcaataacggccggtccaccgtaggggttccctagtacgtacggtcctcttcgttcggcctacccgaaagttccgtcgggacacgaccgggccctccctgggtaccctcgttaccgcgggtcctacccgaggtcctaggacggttaancggaagggcttaggatttactttaagcgtaccttaatctaacgttntgaactgggaccgttacaacttcgttaggggtcttcggaggtacgggaacacggtactcgaccggtacggtaggtacctaacgggcctaacggcgtacccggttccccgtacggtttccggacctttggttaccccccgg

SEQ ID NO: 105904 - DNA, 678 bp, Homo sapiens
  misc_feature: GYAE6OF02HM28U.22.21.B10.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctcctgtacaacaccaccagcacagcccccaaancatgatttangaggtcactaagcgggcctcgacggggtccctgatcgtcttctcgtggcctccaagtcgtggcgacacggcctcccgtagacccgtctcgtcgggcctccgacggcgtcggacggagtggacggtactgtaactttattaacgtggtaccttaacgttcaacttaagtcggacgaacgggtccggtaccgtaaacgtttccggttaggggtttcggttaccgggggacggtaacgggggtaaccctaacggtcccgttacgggtacccccggttaccggttaccggggtcccgtaacgggtacccccgtaaacggggtcccgtttacccgggccccccccggtttacccgggtaccccgttaacccgttcccggtttacccccggg

SEQ ID NO: 105905 - DNA, 555 bp, Homo sapiens
  misc_feature: GYAE6OF02INL29.22.21.B10.1.454.CMB.1.raw
  modified_base (363)..(363): a, c, t, g, unknown or other
  misc_feature (363)..(363): n is a, c, g, or t
  modified_base (442)..(442): a, c, t, g, unknown or other
  misc_feature (442)..(442): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctcctggtaccaacaccacccaggcacacgccccccaaatcatgatttatgaggtcactaagcgggcctcgacggggtccctgatccgcttctctggcctccaagtcgtggcgacncggcctcccgtgaccgtcctcgtcgggtcctccgagggctggaggtatgaggctgtattatacttgccttactctatangcgaggcgcacttggtggttgttcgggcggagggaccagcgtacggtacccgtcgtacggtcacggacccgaaggtccctcgtcccccgttcggtcctaccgttccgttcccg

SEQ ID NO: 105906 - DNA, 649 bp, Homo sapiens
  misc_feature: GYAE6OF02I9YHT.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgccactggaaccagcagtgacgttggtagtacaagtatgtctctgtaccaacaccaccagcacacgcccaaactcatgatttatacgaggtcacgtaacgcggcctcgacgggtccctgactcggcttactcgtcggtacctccgtaacgttcgtcgggaccgtaaccgaccggtcccctcccgtacgtaacccgttccttcgtacgggtcctacccgacggtcgtagggacggtaagtggacgccttaggttaacttaacgttaccgttgtcctaccttacgtatacgttcgacgacggcggtacctaacgttcgttgggttcggttaccggacgggacggtaaccgtagtaccgtacggtaccccggttacgtcggtacctaccggaccccgtacggtcctcccgttccccgtccggtacctaccgttccgttaccccg

SEQ ID NO: 105907 - DNA, 715 bp, Homo sapiens
  misc_feature: GYAE6OF02J1FNA.22.21.B10.1.454.CMB.1.raw
  modified_base (197)..(197): a, c, t, g, unknown or other
  misc_feature (197)..(197): n is a, c, g, or t
tcagacatacgcgtcacgaccggtgctcgatttagtgtcgtcgcaaggggggggtcgtcaggaggcagcgctctcaggacgtcaccaccatggcctgggctctgctccctcctcagcctcctcactcagggcacagggtcctgggcccagtctgccctgacccagcctgcctccgtgtcctggatcatcgtcggacngtcgatcagctatttccagccacgtggaccaacgtagtgaactgtttgggtccttttaggaccttctcgtctaccgtcggtaaccaacaaccacccgacggtaccccaaaccccccctataccatcctatttagtgtcgtacctcgttaccggccggtacccctgaggtacgtcctctaccgtattccgccttcctcgacgtctaccgtaagtcctaggaccaacgtcccggccctacctacgtaccctatccccgttcggtccggtcccgtacccggaacggtctaaccggtaaggtacgtacggtacggtccttaagttacgtttaagttccggagttccgttcgtaacgttgtaacgtttccgggacgtaccgtcccgttaacgttaccggttaccggttggggttccggtaccggggaccggaaccggttacccagggttcccgtaccggtacccgttaccggagttacccgaccggtacccgtacggtccccgttccccggtccccgttacgg

SEQ ID NO: 105908 - DNA, 624 bp, Homo sapiens
  misc_feature: GYAE6OF02GZ3MR.22.21.B10.1.454.CMB.1.raw
  modified_base (296)..(296): a, c, t, g, unknown or other
  misc_feature (296)..(296): n is a, c, g, or t
  modified_base (466)..(466): a, c, t, g, unknown or other
  misc_feature (466)..(466): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacaagtatcgtctctgtaccacaccaccagcacacgccccaaactcatgtatttangtagtacacgtaacgcggcctcgacgggtccctgactcgcttctctcgctacagtcgtcggcgacgccggtcctcccgtgtacccgttcgtccgtcgggtcctcggacggtcgagggtaggtacgtaggagtctagttacttattacgttcgtacttacttacgaattancgacgacgggacgaccttaacgtcggttgggttacggttacgggacgggtaacggtaaccgacggtccgtaccggtaccgttacggtaccgtaccggtaccgtaccggacggtcccgtcccggtaccccgttacggtccctaccgtccgttacccccg

SEQ ID NO: 105909 - DNA, 591 bp, Homo sapiens
  misc_feature: GYAE6OF02GPA1N.22.21.B10.1.454.CMB.1.raw
  modified_base (245)..(245): a, c, t, g, unknown or other
  misc_feature (245)..(245): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctggcccagtctgccctgactcagcctccctccgcgtccgggtctcctggacagtcagtcaccatctcctgcactggaaccagcagtgacgttggtggttacaagtntgtctcctgtaccaacaccaccagcacacgacccccaatcatgatttatgagtcacgtaagcggcctcgacgggtccctgactcgcttctctggctcagtctgcgacncgcctccngacctctcgtggctcgagtctggagagtgacggtctagtattacgttacgtcgtaccttactactatatggacgacgggccgacgtaccgttcggtttggggttcggttccgggacgggtaacgggaccgtaacggtccgtacggtacccgttccggttaacgggtccaaccggtacccgaacgggtcctcccggtcccccggtcggtacctacccgttcgttacccccg

SEQ ID NO: 105910 - DNA, 553 bp, Homo sapiens
  misc_feature: GYAE6OF02JTUD6.22.21.B10.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (404)..(404): a, c, t, g, unknown or other
  misc_feature (404)..(404): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacccagcagtnacgttggtcgttacagtntgtctctgtaccacaccaccnggcacacgccccaaactcacngtacttangaggtcaactaagcgggcctcgacggggtccctgactcgcttctctcggcnctaagtctggacgacacggcctcccgtgcccgtactcgtggcctccgaggctgacggntggagctgacttattatcgtctactcgtatacgtcgcgaggcgacgtacctgtttcgggtgttaccgggtaggacgggtacaacgcttacggacctccggtaagtccacggtacccaggtctaccggccccgtaggtccacttcgtccg

SEQ ID NO: 105911 - DNA, 676 bp, Homo sapiens
  misc_feature: GYAE6OF02JF8KX.22.21.B10.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (391)..(391): a, c, t, g, unknown or other
  misc_feature (391)..(391): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtcccgggtctcctggacagtcagtccaccatccncctgcactggaaccngcagtgacgttggtaggttacaagtntgctctggtaccacaccaccaggcacacgcccccaatcatgattangacgtcactaaggcggcctcgacgggtccctagtactcgcttctcgtcgcctaccagtcgtcggtaccgacgacggccctccgtacgaccgtcncgtacgggcctaccgaggtcctaggacggtagtacggacggtactagtaacgtttacgttacttcgtaccgtaacttcgaatacgtgccggacggtaccggtacctaacgttcggttacgggttcggtttacggggaccgggtaacggggtaacctaacggtccgtacgggtaccccgtttcccggttaaccgggttaccgaaccggttaccccggaacgggttcccggttccccggttacccccggttacgggtacccttacccggttcccctttaaccccggg

SEQ ID NO: 105912 - DNA, 524 bp, Homo sapiens
  misc_feature: GYAE6OF02GK8ZD.22.21.B10.1.454.CMB.1.raw
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
  modified_base (501)..(501): a, c, t, g, unknown or other
  misc_feature (501)..(501): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacaagtatgtctctggtaccaacaccaccaggcacacgacccccaaactcatgatttangaggtcactaagcggcctcgagggtcccngatcgcttctcgtggctccaagtctggcgacacggcctccctgaccgtctcgtcgggctccgaggctgagagtaggacggctgtattattacgtgtcttactacatatgcaggcgctaactgttggtgtcggnggacggacacgtcngaccgtcgtacgtcacgaccgaggccncgccccgtcgtcacctcttcccg

SEQ ID NO: 105913 - DNA, 519 bp, Homo sapiens
  misc_feature: GYAE6OF02FPHB4.22.21.B10.1.454.CMB.1.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacgagtcagtcaccatctcctgcactggaaccagcagtgacgttggngttacaagtntgtctcctgtaccacaccaccagcacagcccccaaatcatgattatgagtcactaagcggcctcgaggggtccctgactcgcttctctggctccaagtctggcgacacggcctccctgaccgtctcgtggctccgagctgagntgaggctgattattactgcttacnatatgcaggcgcaacgttcgttgggtcgttcggcggtacgggaccaggctgaccgttcgtaggtcacggccaaggcctcggcccccgtggtccaccgtcgtacccg

SEQ ID NO: 105914 - DNA, 686 bp, Homo sapiens
  misc_feature: GYAE6OF02IDB4N.22.21.B10.1.454.CMB.1.raw
  modified_base (113)..(113): a, c, t, g, unknown or other
  misc_feature (113)..(113): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcngcctcctcactcagggcacagggtcctgggcccagtctgccctgactcagcctccctccgcgtccgggtctccgtggacagtcagtccaccatcctcctacacgtaggaaccagcagtgatgtggtagttataactntgtctctcggtacaacagccaccagacaaacgccccagtactcatctatttancgtctagtcaattaaggcccgcctacggacggggtccctagtacgtcgtcttctcgttcgacctaccgaagttccgtacggaaccaaccgacccgtcccttacccgtacgaccctatccgttcgtcgggcctcccgagcgtaagaagacgtaggacggtctaggttaacttttattacgcttcgcggtaccttagttacgtttcggacgtacgggtacctaccgtttaaaccgttcggtttaggggttaccgggttttcggggaccggggtaaccggtaccgaacggttccgtaacgggttcccgtaacccggtttaacgggccgtaaacccggccggtaaacgggtccccggtttacccggacccccggttaccgttacccg

SEQ ID NO: 105915 - DNA, 661 bp, Homo sapiens
  misc_feature: GYAE6OF02H7FMH.22.21.B10.1.454.CMB.1.raw
  modified_base (219)..(219): a, c, t, g, unknown or other
  misc_feature (219)..(219): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctcctccgcgtccgggtctcctggacagtcagtcacatctctgcactggaaccngcagtgacgttggtcgttaacaagtatgtctcctggtaccaacaccaccaggcacacgacccccaaactcatgatttatgaggtcaactaagccggtactcgacgggtccctagactcgtcttctcgtgctcaagtctggacgacgaccggtcctcccgtagcccgttcgtaccgtcgggtctaccgacggtcgtacggaaggtacgttacggaggtcgttacgtaacttttacgttaaccgttcgtaaccttactaccgtaaatttcgagtacgacgggtccggtacctaaacgtttcggttacggggttcgggttaccgggacggttaaaccggggaccttaaacggtcgtaccggtacccggtaccgtaacgggtcaaaccggcccgtaagggttccctcccggttacccccgtcggtaccgtcccttccggttcccgg

SEQ ID NO: 105916 - DNA, 573 bp, Homo sapiens
  misc_feature: GYAE6OF02IL7WA.22.21.B10.1.454.CMB.1.raw
  modified_base (245)..(245): a, c, t, g, unknown or other
  misc_feature (245)..(245): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctcctggtaccaacaccacccaggcacacgacccccaaatcatgatttatgaggtcaacgtaagccgggcctcgacggggtccctgactcgcttctctggcctacaagtctggacacacggcctccctgacccgtctcgtcggctccgaggtctgaggactgacgctgtattattacgtcgtactacttcaatatgacgcggtacgtctaacgttcggttgggttacgttcgggcggtaacggaccgaagccgtagacccggtcgtacggtcgacgacccgaaggtccctccgtcccccgttcggtccctaccgtcccgttcccg

SEQ ID NO: 105917 - DNA, 704 bp, Homo sapiens
  misc_feature: GYAE6OF02GPC5R.22.21.B10.1.454.CMB.1.raw
  modified_base (220)..(220): a, c, t, g, unknown or other
  misc_feature (220)..(220): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcttgggcccagtctgccctgactcagcctccctccgcgtccggtctcctggacagtcagtcaccatctcctgcactggaaccngcagtgacgttggtaggttacaagtatgtctcctgtaccaacaccaccagcacacgacccccaaatcatgtattangagtcacgtaagcggcctcgacgggtccctgactcgcttcgtctcggtacctaccgtaaggtcgtcggaccgaacgaccgggtcccttcccgtcggtacccgttctcggtcgggcctccggacggtccgtaggaggtacgtcggaacgggtcttaggtaacttttaacgttaccgttcggtacccttaaccttcctaaagttagttacggacgtaacgggacccggtacgtaaaccggtttccggtttacggggttcgggttaccggggaccggggtaaaccgggtacccgtaagggttccgtaccgggtacccggtttaccggttacgggtacccgtaccggtaccccggtaaggtcccgtacccggtccccccggttacggtacccgtaccgttcccgttcccccg

SEQ ID NO: 105918 - DNA, 602 bp, Homo sapiens
  misc_feature: GYAE6OF02FPJ2F.22.21.B10.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccngcagtgacgttggtggttacaagtntgtctcctggtaccaacaccaccaggcacacgcccccaaatcatgatttagnggggtcactaagcggcctcgacggggtccctgactcgcttctcgtgctccaagtctggcaacgacggccctaccctaaccatcctcgtcgggcctccgtaggtttcgaggaccgagtcttactttattactgctagtttacctttaaagttcggcctccacttcttcggttggttttcggcggtggtccaccggtaagtcgacccgttcctccggtcacgacccgaaggtccttcggcccccttcgggtcctaccgttcccgttccgttcccccgtacccttcccgtacctacccggtcgttacg

SEQ ID NO: 105919 - DNA, 618 bp, Homo sapiens
  misc_feature: GYAE6OF02IDD9G.22.21.B10.1.454.CMB.1.raw
  modified_base (300)..(300): a, c, t, g, unknown or other
  misc_feature (300)..(300): n is a, c, g, or t
tcagacatacgcgtcacgaccggtgctcgatttagtgtcgtcgcaaggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacacaccaggccaaaccccccatcatcatttactgtgtcnctcgtccggccctcaggagtctctcatccgtcttctcaggcctccaagttctggcaacaccggcctaccctaaccatcctcgtcgggccttccgtaggtttcgaaggtacgagttacctacttattaactcgtacttacgtttcctttaaattccggctccctaattccttggttcgttttccgggcgggtaagtccgaaccgtaacgtcgtaccgtcctcggtacacggtacccgtaagggtccctacggtccccccgtcggtacccgtacccgttacgttcccggttcccccaaccccttcccgttacctacccgg

SEQ ID NO: 105920 - DNA, 661 bp, Homo sapiens
  misc_feature: GYAE6OF02JLSPE.22.21.B10.1.454.CMB.1.raw
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (399)..(399): a, c, t, g, unknown or other
  misc_feature (399)..(399): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtccaccatcctcctgccacgtggaaccagccagtgacgttggtcgttacaagtntgtcctccgtggtacccaacaccacccgaggccacgacgacccccaaactcaatcgtaatttntcgaggtaccaacgtaagccgggcctacgacgggtccctagtacgtcgtcttctcgtcggcctccgtaagtcgtcggcgaaccnccggtccctcccgtcgacccgttctcggtcgggccctccgagggtctaggaggtacttggacggtcgtagtactttacttacgtcgtacttactaccgtatacgtcgacgtaccgggtcgtacccgttaagttccgggtttaggggtcgtttaccggggacggaaccggtaccgagttcggtacgacccgggttcgtacggtaacgcccgacggtaacgcccgttcccgacccccgttggtaccctaccgttccctcccggg

SEQ ID NO: 105921 - DNA, 651 bp, Homo sapiens
  misc_feature: GYAE6OF02FZXLV.22.21.B10.1.454.CMB.1.raw
  modified_base (223)..(223): a, c, t, g, unknown or other
  misc_feature (223)..(223): n is a, c, g, or t
  modified_base (302)..(302): a, c, t, g, unknown or other
  misc_feature (302)..(302): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtggttacaagtatgtctcctggtaccaacaccaccagcacacgacccccaaactcatgtatttagngtaggtcaacgtaaggcgggtcctacggacgggttccctgactcgcttctcgtcggctaccgagtctgggacgacgaccggtccctcccgtcgacccgttcgtcggtcgggtcctccgacggcgtggaggatgggaggtctagtactttacttacgtcgtctacttacgtactaaggtccgacgacgggaccggtactaacgttcgggttgggttcggttcggggacgggaacgggtaaccgaacgtcggtaaccggtacccgggttacggtaccggtccgaacccggtacccgtaacggtcccgttcccggcccccgttacggtcccgttacccgttcccgtccccgg

SEQ ID NO: 105922 - DNA, 623 bp, Homo sapiens
  misc_feature: GYAE6OF02GLE3F.22.21.B10.1.454.CMB.1.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctgggcccagtctgccctgactcagcctccctccgcgtccggtctcctggacagtcagtcaccatctcctgcacgtggaaccngcagtgacgttggtgttacagtntgtctctgtaccaacnccaccgagcacacgaccccaatcatgatttagngagtcactaggcggtcctcgacgggtcccngactcgtcttctcgtcgcctacgagtccgtggccgacgaccgggtccctcccgtacggtacccgttccgttccggtcgggtccctccggaggtcctagggacggtacgtgggacgtcgtagttaactttacttaccgttcgtacctttacctctaattcgtcgacggtccgggaccgtaccgtacgtttcggttggggttcggttcgggacgggacggacgcggtcgcggtaccgtcgtacggcgaccggaccgaggcccgttacccggccccgttggacccttcgtccgttaccccg

SEQ ID NO: 105923 - DNA, 532 bp, Homo sapiens
  misc_feature: GYAE6OF02FM2YG.22.21.B10.1.454.CMB.1.raw
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgtgtctggatcatctggacagtcgatcagcatttcctgcactgggaccaacagtgacattgggtcttttgactctgtctcctggtaccaacaacacccaggcaaacccccccactcatcatttatggtgtcactcgtcggccctcaggagtctctcatcgcttctcaggctccaagtctggcaacacggcctccctaaccatctctggctccagtttgaggacgagtctacttattactgctagttaccttaaattcgaccgtctactcttcgtgttttcggcgtagcacgagtgaccgttccgcgtcacgccgaacggcctacgccccgtcggtcaccttcctcgttccccacctccc

SEQ ID NO: 105924 - DNA, 619 bp, Homo sapiens
  misc_feature: GYAE6OF02IJXU6.22.21.B10.1.454.CMB.1.raw
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtccaccatctcctgcactggaaccngcagtgacgttggtgttacagtntgtctctgtacaacaccaccagcacacgaccccaaactcatgatttangaggtcagtaacgccggctacgacgggtccctgactcgtcttctcgtggtcctacagtcgtggacgacgaccggccttcccgtcgaccgtctcgtcgggctccgacggtcgtaggagagtggacgtctaggtatttaactcgttacgtaccttacgtactaagttatcggacgtacgggcggtacctaacgtttcggttaggggttcgttacgggacgggtaacgggaacgtacgcgtaccggtacccggtacggtacggcctaaccggaccctaacggtcccgtacccggtcccccgttacgggtccctaccgttccgttaccccgg

SEQ ID NO: 105925 - DNA, 672 bp, Homo sapiens
  misc_feature: GYAE6OF02JB4GC.22.21.B10.1.454.CMB.1.raw
  modified_base (221)..(221): a, c, t, g, unknown or other
  misc_feature (221)..(221): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactatgtctctggtaccaacaacaccagacaacgccccaancatgatttangagtcaacgtaggccgcctcggacgggtcctgactcgtcttactctcgtctactaagtcgtacggacaacgtaccggtcccttccgtcgtaccgttcctacggtcgggtcctaccgagggtccgtggaacgggtacgtagggtacggtacgttagttaaggttttaaccttaccggtggtaaccgtacgttaccttacgtaagttacggacgggtacggcgtaaccggtacgtaactttaaacgggttttcggggtcggtttacggggaccggaacgggtaaccgtagtccgtacggtacccggtaccggtacgggtaccgaccggtacccgaacggttccctcccggtaccccgtcggtactacccgtccgttccccgg

SEQ ID NO: 105926 - DNA, 644 bp, Homo sapiens
  misc_feature: GYAE6OF02H2HZ5.22.21.B10.1.454.CMB.1.raw
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgccacgtggaacctagcagtgtacggttggtgttaacagtatgtctctcggtaccaacaccaccaggcacacgaccccaactcagtatatttangtaggtcaacgtaaggcggccgtcgacgggtccctgactcgtcttctctgctcaagtcgnggcacgcgcctcctcgaccgtctcgtcggctaccgacggtctaggacggtatggacgtctagtactttaacgttactcgtacttacttctaacgttacgtacggccgtagggaccggtacgtaaacgtttcggttacggggttcggttaccgggacggtaaccggggaacctaagtccgtacggtacccgttaccggtaacggtaccgaaccgaccccggaaggttcccgtacccggcccccggtttaccggtacccgttacccgtttaccgttacccccg

SEQ ID NO: 105927 - DNA, 670 bp, Homo sapiens
  misc_feature: GYAE6OF02I8N3A.22.21.B10.1.454.CMB.1.raw
  modified_base (222)..(222): a, c, t, g, unknown or other
  misc_feature (222)..(222): n is a, c, g, or t
  modified_base (301)..(301): a, c, t, g, unknown or other
  misc_feature (301)..(301): n is a, c, g, or t
  modified_base (600)..(600): a, c, t, g, unknown or other
  misc_feature (600)..(600): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtccaccatcctcctgcactgaaccngcagtgacgttggtgttacaagtatgtcctctggtaccaacaccaccaggcacacgacccccaaatcatcgtatttacngtacggtcaactaaggcgggtacctcgacgggtcctgattccgcttctacgtcggtctaccgtaagtccgtagggccgaaacgtccgggcccttcccgtcggtacccgttccgttcgtcgggggtcccttaccggacggtccgtgggaacggtagtcggacgtcgtacgttagttaccttacgtcgtccgtactacctagtacgtgacgaacgggcgtacctaacgttccggttgggtttcggttcgggacggtaacggacgtaacgccgttacggtacccgttcggttaaccgggttnaaccccgggtacgtaacccgggccgttacccggcccccgttacgggtaccctaccgttccgttcccccgg

SEQ ID NO: 105928 - DNA, 725 bp, Homo sapiens
  misc_feature: GYAE6OF02HGMRF.22.21.B10.1.454.CMB.1.raw
  modified_base (297)..(297): a, c, t, g, unknown or other
  misc_feature (297)..(297): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccaccagcacacgcccccaaatcatgtatttangaggtcacgtaaggccggcctcgacggggtccctagactcgctttcgcgtcggcctccgtaagtcgtggaccgaccgaccggcccttacccgtcggtacccgtcctaccggttcgggcccttacccggaacgggtccgttagggaacggtagtagggacggtcgtaggtaacttttaacgtttaccgttggtacccttaccgttacttaattacgacgtacgggacgggtacccgtaaccgtaaccgtttcgggttttaggggtaccgggtttccggggaccgggaaacggggtaacccgtaaggtcccgttacgggtacccggttccgggttacgggttacccgaaccggtaccccggtaacgggtcccgttaccccgggtaccccccggttcggtaccccgttaccgttcccggtttccccccggg

SEQ ID NO: 105929 - DNA, 511 bp, Homo sapiens
  misc_feature: GYAE6OF02GMN9U.22.21.B10.1.454.CMB.1.raw
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccaccaggcacagcccccaaatcatgatttangaggtcactaagcgggcctcaggggtccctgatcgcttctctggctcaagtctggcgacacggcctccctgaccgtctctgggctccaggctgaggatgaggctgattatactgcttactcatatgcaggcgacaactcgttgggtgttcgggcggagggaccaagctgaccgtctaggtcagcccaggcctcggccccctggtctacgtctccg

SEQ ID NO: 105930 - DNA, 696 bp, Homo sapiens
  misc_feature: GYAE6OF02GQZKO.22.21.B10.1.454.CMB.1.raw
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacaccaggcaaacgcccccaaatcatgatttangaggtcactaagccggccctgacggggtccctgatcgcttctcgtcggtcctcaagtcgtggacaaccgacggccctccgtcgacccgttctacgtgggcctccgaggtcctaggacgggtatacggacggtcgtaggtaactttaacgttaccgttacggtccgtagtccttactagttagtacggggtaaggccgtaggaccgtaacgtttaaaggttttcggggttacgggtttcggggacggggtaaccggggtaaccgtaacgggtccgtttaacgggaccccggtttaaccggttaacgggttaccggaaccggtacccccggtaaagggtccccgttccccggtaccccccggttaccgggttacccgttacccgttaccccgtttacccccgg

SEQ ID NO: 105931 - DNA, 607 bp, Homo sapiens
  misc_feature: GYAE6OF02GX1EJ.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctcctgtaccaacaccaccagcacacgcccccaaactcatgatttatgagtcacgtaaggcggcctcgacgggtccctgactcgcttctcgtcggcctccgaagtcgtcggacgacgaccggccctccctcggtacccgtctcgtcgggctccgaggctggaggatggacggtcgtagtacttattactgtcctactcattagtcgacgcgggacgacctaacgttcggttagggttcgttcgggacgggaacgggtaccaaggtccgtacggtacccgtccggttaacggtccgaaccggacccgtaaggtcccgtcccggtcccccgttacggtaccctaccgttccgttaccccgg

SEQ ID NO: 105932 - DNA, 713 bp, Homo sapiens
  misc_feature: GYAE6OF02GHM9Y.22.21.B10.1.454.CMB.1.raw
  modified_base (303)..(303): a, c, t, g, unknown or other
  misc_feature (303)..(303): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctcgcgtccggtctcctggacagtcagtcaccatctcctgacacgtacggaaccagcagtgacgttggtggttacaagtatgtctcctgtaccaacaccaccaggcaccgacgacccccaactcatgtatttangagtaccaacgtaaggccggtcctacgacgggtcccagtctaccgtcttctacgtggtcctacgtacgtcgtcggccgacgacgtcccgtcctcggaccgttccgtcggtcgggcccttccggacgggtcctagggtacgggaacgtgggtacgacgtttagttacgtttaacttaccggttacgttactttaacccgtcgttaagtacgtcggaaccgtgggtaccgtaccgttaaccggttttcggtttcgggggttacgggttccggggaaacgggtaccgggtaacccgtagttacccgggtacgtacccggttacggttaccggaacgtacccggtaacccggtacggtaccccgtccggtaccccccggttcgtacccggttccgttccccgtttaacccccgg

SEQ ID NO: 105933 - DNA, 581 bp, Homo sapiens
  misc_feature: GYAE6OF02GKU66.22.21.B10.1.454.CMB.1.raw
  modified_base (351)..(351): a, c, t, g, unknown or other
  misc_feature (351)..(351): n is a, c, g, or t
  modified_base (391)..(391): a, c, t, g, unknown or other
  misc_feature (391)..(391): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacacgcccccaaactcatgatttatgagtcactaagccggcctcgagggtccctgactcgcttctctggctcagtcnggcacgacgtcctcccgtgacccgtctcgtgggcctccgnggctggaggatggagtctgtaactttacttactgtctactctatatgcgtaggccggactaacgttcggttgggtcgttcgggacgggagggaaccgacggtcgtacgtacccggtccgtacggttaccaccggtacccgtaacgggtctacccggtcccccgtacggtccctaccgtcctttaccccgg

SEQ ID NO: 105934 - DNA, 759 bp, Homo sapiens
  misc_feature: GYAE6OF02F00SS.22.21.B10.1.454.CMB.1.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctgggcccagtctgccctgactcagccctccctccgcgtccgggtctccgtggacagtcagtcaccatctcctgcactggaaccagcagtgacgttggtgttacagtntgtctctgtaccaacaccaccaggcacacgacccccaaactcatgtatttangagtcacgtaaggccggcctcgacgggtcctagacgtcgtcttctcgtcggcctacgaacgttcgtacggcccgaaccgaccggtccccttacccgtcggtacccgttccgttaccggtcgggtccctccggacggtccgtagggacggtacgttcgggacggtcgttagtaacgtttagttaccgtcgtaccttaaccgttactaagttactcggacggttaacgggccggtaaccgtaaccgttttccgggtttaggggtttccgggttaccgggtaacggggaaaccgggttacccgaaacgggtttcccggtaaccgggttaccccgggttaacccgggttaccgggtaaccccggtaacccgggttaaccccggtaaccgggtcccgttaccccccgggtaccccccggtttaccgggtaaccccttacccggtttcccggtttacccccccgg

SEQ ID NO: 105935 - DNA, 934 bp, Homo sapiens
  misc_feature: GYAE6OF02IQGIE.22.21.B10.1.454.CMB.1.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacgagggtcctgggcccagtctcgccctgacctcacgcccttccctccgccggtccgggtcctcccgtggactagtcacgtccaacctactccgttcctggccacgttacgggaacccaggtacctaaggttcgggttaaccgggtttggggttaccgggttttaaaccaaagggtttaacgtttcggtacccttacccggttaacgggttaaaccccctaaaaccccgtaccccgaacccccgtaaacgggcccaaacccgaaccccggtaccccccaaaaacgttcccaagttacggtaattttacgtaggtacggtacctaacgtaacgggcccgggtaccgtaccggtaaccggggtcccttacgtcgttccgtaccgtttccgtccgttaccggtccctaccgtaacggttccgtacgggactacggacccggtaccctcccgtacggtcccgttcgtcccgtcggggttaccttcccggaacggtccggttagggaacggtacggtcggtagtaccgttgtaaccgttttcttaccgttacggacctttaaccgtacccgttaattacggacgtccgggtaacgggtaccgttaacgttaacccgggtttcggttcggggtttaccgggttaggggaccgggtaaccggggtaaacgtacccggggtttcgtacggtttaaccccggttacccgggttaacggcccgtaaacccggtaccccgggaaccggttcccgggtcccgtaccccccgggttacggtttccccggttaacccgttttcccgttacccccccgg

SEQ ID NO: 105936 - DNA, 630 bp, Homo sapiens
  misc_feature: GYAE6OF02JQ2H7.22.21.B10.1.454.CMB.1.raw
  modified_base (258)..(258): a, c, t, g, unknown or other
  misc_feature (258)..(258): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacaggtccagtccaccatccgtcctacacgtcggaacctgccagtgacttgttacggtggttaataactntcgtcctccgtgtaccaactagccacccgagacgaaacgtcccccagactcatcctattactcgacttgtacaacgtaacggcccgccctacggacgggtccctagtactccgtcgttctcgtcggtcctacctaaggtcctcggacctaaccgtaccggtcccttaccctgaaccctacgttccgtcgtcgggtcctaccgacggtcgtaacgaacgtagtcggtacgcgtagtacttacgttactgtcctatcgtacttagttcgacgtacgtcaccgttacgtcggttggtcgtcgggaccggtacgacgtcgacgtcgtaccgtcgtagaccgtacgtaccggagtccgtcccgtcccgtcgtacccg

SEQ ID NO: 105937 - DNA, 733 bp, Homo sapiens
  misc_feature: GYAE6OF02JPNWE.22.21.B10.1.454.CMB.1.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
tcagacatacgcgtcacgaccggtgctcgatttagtgtcgtcgcaagggggggtcgtcgaggaggcagcgctctcaggacgtcaccaccatggcctgggctctgctcctcctcagcctcctcactcaggcacagggtcctgggcccagtctgccctgactcagcctcctccgcgtccgggtctcctggaccagtcagtcaccatctcctgcactggaaccagcagtgacgttgngttaactntgtctctgtacacacaccaggcaacgccccaaatcatcgtatttacngacgtcactaaggccgtccctcgacgggtccctaggactcggtcttacctcgtacggtccctaccgtaacgttcgtcggaccctaaacgtcccgggtccccttaccccgttacgaaccccgttccttccggtacccggggtcttacccggacgggtccttacggagggtaacgtcggaacggtctacgggtaacttttacgtacgtcggtactacggtacccgtatacgttaatcggggacgtccgaaggtcccgtaaacgttaaggttttcgggtacggtttaccggggaccgggtaacggggtaaccgtacggtccggttaccggtacccggtttaacccgggtacggttacccggaaccgggtaaccccggtaaggtccccggttacccggtcccccccgttaggggttaccccttaacggtcccccgttttaacccccgg

SEQ ID NO: 105938 - DNA, 655 bp, Homo sapiens
  misc_feature: GYAE6OF02FGLWA.22.21.B10.1.454.CMB.1.raw
  modified_base (222)..(222): a, c, t, g, unknown or other
  misc_feature (222)..(222): n is a, c, g, or t
  modified_base (302)..(302): a, c, t, g, unknown or other
  misc_feature (302)..(302): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtccacatctcctgcactggaaccngcagtgcgttggtgttacaagtatgtctcctggtaccaacacccaccaggtaccacacgaccccccaaatcatgatttangagtacactaagcggtcctcgacgggtccctgactcggtcttcgtcgtcggcctaccgaagtctcggaccacgaccggcctcccgtcgaccgtctcgtcgggcctcgtaggctgaggtactggacgtcgtagtaagttaacttccgtgtaccttactacgtaattacgtcgaacgacgggcgtaccgtaacgtttcggttcggggttacgttccgggtacgggtaccggggaaccctaagggtccgtaccggtacccggttaaccgtacgggtacccgtaaccggtaccccggtaacggcccgttaccccggtacccccgttcggtacccctaccgtttacccgttcccccgg

SEQ ID NO: 105939 - DNA, 764 bp, Homo sapiens
  misc_feature: GYAE6OF02GPEIL.22.21.B10.1.454.CMB.1.raw
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (324)..(324): a, c, t, g, unknown or other
  misc_feature (324)..(324): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctgggcccagtctgccctgactcagccctccctcgcgtccgggtctccgtggacagtcacgtcacctatcctcctgcacgtacggaaccngcaggtcgtacggttggtagttaacaagtntcgtcctccgtagtaccaacaccgaccgacggacacgaccgaccccaaactcaatgtatttagnggtacgtactaacgacggccggtcctcggacgggtcccaggtactcgtcttcgtcgtcggacctacgtacgtcgtacggaccgaccgtaccggtcccttcccgtacggtacccgttcgtccggtcggtacccgtcgacgggtccgtaggacggtagtacggtacggttacgttacggttaactttacgttaccgttcggttaaccttacgtccgttaaattacgtaccggacggtaccggggtaccggtaaccttaaccgggtttcgggtttacggggttcggggttacccggggtaacggggaaacggttaaccggtacggtccggttaccggttaacccgggttaccggttaacggtaccggtacccggtaaccgtaacgggttccctacccggggtcccccgttacggttacccgtccgtttacccgttacccccgg

SEQ ID NO: 105940 - DNA, 733 bp, Homo sapiens
  misc_feature: GYAE6OF02G16QC.22.21.B10.1.454.CMB.1.raw
  modified_base (193)..(193): a, c, t, g, unknown or other
  misc_feature (193)..(193): n is a, c, g, or t
  modified_base (337)..(337): a, c, t, g, unknown or other
  misc_feature (337)..(337): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacngtcagtcaccatctcctgcacgtggaaccagcagtgtacgttggtggttaacaagtatgtctcctcggtaccaacaccaccgaggcacacgaccccaaactcatgtatttatgagtcagtaacggccggcctcgacgggtcccngactcgtcttctctggctaccgaagttcgtcggacgaccgaccggtccctcccgtacggtacccgtctcgtcgggtcctccgacggtcgttaggaaggtacgtcgggacggtcgttaggtaacttttaacgttaccgtcgtttaccgtaacttacgtaacttacgtacggacgtacggggaccgtaccgtttaaacgttccgggtttcggggtttcgggtttaccggggaccggggtaaaccggggtaacccgtaacgggtccggttaaccgggtaaccccgggttaccggttaaccgggccggtaaacccggtaccccggtaacgggttcccggtaccccggtaccccccggtttacgggtaacccctacccggtttccccggtttacccccggg

SEQ ID NO: 105941 - DNA, 665 bp, Homo sapiens
  misc_feature: GYAE6OF02HEWR2.22.21.B10.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctcctccgcgtccgggtctccgtggacagtcagtccaccatctcctgcactggaaccngcagtgacgttggtacgtacaagtntcgtctctcggtacaacnccaccgagcactacgcccccaaatcatcgatttagngtacgtacaacgtaaggccggtcctacggacgggtccctgactcgcttcgtcgtcggacctccgtaagtccgtaggaccacgaccggtccctaccgtcgtacccggtctcgtcgggccttaccgaggtcctaggacgtagtgggacgtcttagtatttaacgttctacggtacttactcgtaatttacgcgtacggtacgggtccgtacctttaaccgtcgggttttacggggtacgttaccgggggtaggtaaaccgggaccttagggtaccgtacgggtacccgttacgggtacggtccaaccgacccgggtactcccggttcccacccccggttggtacccgcttcccggttacccccgg

SEQ ID NO: 105942 - DNA, 680 bp, Homo sapiens
  misc_feature: GYAE6OF02J2P7X.22.21.B10.1.454.CMB.1.raw
  modified_base (132)..(132): a, c, t, g, unknown or other
  misc_feature (132)..(132): n is a, c, g, or t
  modified_base (245)..(245): a, c, t, g, unknown or other
  misc_feature (245)..(245): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcaggcacngggtcctgggcccagtctgccctgactcacgcctccctccgcgtccggtctcctggacagtcagtcaccatctcctgcactggaccagcagtgacgttggtaggttacaagtntgtctcgtggtacacaccaccaggcacacgccccaaactcatcgtattagtcgtacggtcaacgtaacggccggtcctcggaccggggtcctgacgtccgtcttctcgtcggctccgagtcgtcggcgtacgaccggtcctccgtcgaccgttcgtcgtacggtcctaccgtacggtcgtacggaggtcgttagggacgtcgttacgtactttaacgttaccgtcgtaccgttactacgtattacgtcggtcgaacgggtccgtacccgtacgtttccggtttacggggttccgggttaccgggtacgggtaacggtaccgtaaggtccgtaacgggtacccgttaaccggttacggtaccgtaaccggacccgtacgggtccccgtcccggtaccccggttaccggtaccgtacccgtttccggttacccccgg

SEQ ID NO: 105943 - DNA, 623 bp, Homo sapiens
  misc_feature: GYAE6OF02IASWT.22.21.B10.1.454.CMB.1.raw
  modified_base (113)..(113): a, c, t, g, unknown or other
  misc_feature (113)..(113): n is a, c, g, or t
  modified_base (188)..(188): a, c, t, g, unknown or other
  misc_feature (188)..(188): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
  modified_base (559)..(559): a, c, t, g, unknown or other
  misc_feature (559)..(559): n is a, c, g, or t
tcagacatacgcgtcacgaccggtgctcgatttagtgtcgtcgcaagggggggggtctcaggaggcagcgctctcaggacgtcaccaccatggcctgggctctgctcctcctnacgcctcctcactcagggcacgacgggtcctgggcccagtctgccctgactcagccctccctccgcgtccggtcncctggcagtcagtcaccatcctctgcactaggaaccagcagtgacgttggtagttacagtntgtctcgtcggtacaacaccaccgagcacacgacccccaactcatntatttangtagtacactaggcgctcgacgggtcctgactcgtcttctntcgccttaccgaagtcgttaggaccgacgaccggccctcctcgtaccgtcgtcgtcggcctaccgagtcgtacgaggagtcggagccgttatagtttaataccgttaggtacctacgttntaacgttntcgcgtaacgggcggacctaacgttcggttagggtcgtttacgggacggtacggaccgtagccgtacgtacccggtcgttacggtacnccggtaacccgtaggccgtcccggtcccccggttacggtcccgttacccgtcgtttacccccgg

SEQ ID NO: 105944 - DNA, 744 bp, Homo sapiens
  misc_feature: GYAE6OF02JVL4D.22.21.B10.1.454.CMB.1.raw
  modified_base (150)..(150): a, c, t, g, unknown or other
  misc_feature (150)..(150): n is a, c, g, or t
  modified_base (341)..(341): a, c, t, g, unknown or other
  misc_feature (341)..(341): n is a, c, g, or t
  modified_base (667)..(667): a, c, t, g, unknown or other
  misc_feature (667)..(667): n is a, c, g, or t
  modified_base (737)..(737): a, c, t, g, unknown or other
  misc_feature (737)..(737): n is a, c, g, or t
tcagacatacgcgtcacgaccggtgctcgatttagtgtcgtcgcaagggggggtcgtcaggaggcagcgctctcaggacgtcaccaccatggcctgggctctgctcctctcacgcctcctcactcagggcacacggtcgtcggccagtcncgcctgactcacgcctccctccgcggtccggtcctccgtaggacacgtcgagttccactatcctactcgctaacgtacggacaggtcagtaccgtggtggttcggtaacatacgtcgttccttccgtaggtacccaacgtacccaaccgacgccgactaccgacccccaaacgtcacgtagtactttaacnggttacaccgaacggttacgccgggtaccgtaacggccggttacccgtaggtaccttcgggtccttcgttcgacgggtcctaaccaacggttcgtaccggacccggaacctccggtccctacccggttctaacccggttcgtcggtaccgggtctacccggttcggaccgttagacggttacggaccggtaaggttaccgttagttacgtttaacgttccgtactacccgttcgtacgttaaccgtagtaccgtaaacgtacccgtacgggtccgggtacgtccgggttcggttacgtaccgggtacgggaccgtaacgggttacnccgtcggtaccggccttacggacgaacccgttcgaacggtcgtaccggcccgttaccggtcgtaccgttntaccccg

SEQ ID NO: 105945 - DNA, 771 bp, Homo sapiens
  misc_feature: GYAE6OF02FOFGF.22.21.B10.1.454.CMB.1.raw
  modified_base (130)..(130): a, c, t, g, unknown or other
  misc_feature (130)..(130): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggnacagggtcctgggcccagtctgccctgactcagccctccctccgcgtccgggtctccctggacagtcagtccacatctcctgcactaggaaccagcagtcgacggttggtgttacaagtatcgtccttccgtaggtaccaacacccaaccgacggccacgaccgacccccctaaaagtcaagttcgtatttagtggtacggttaccaacgtaacggcgggtcctccggtaacggggttccctaggtacgtccgtaccttcgtcgtacgtccctacgtacgttccgtacgggacgtacgacccggtcccttacccgtcgtacccgttcgtcccgttcgggtccctccgtacggtcgtaagggtacggtagttacggtacggtactaggttacgtttaacgtttacgtacgttaccttaccttaattacgttaggtcgtacggtacgggacccggttaacgtaccggtttccggtttcggggtttaccgggttaccggggtaccgggtaacgggaaccggttaccggtaccggtaccggtacccggtttaaccggtaccggtaaccggtacccggtacccgtaaccgggtcccgtccccggtaccccggttcccggtacccgttccttacccggttcccccgg

SEQ ID NO: 105946 - DNA, 698 bp, Homo sapiens
  misc_feature: GYAE6OF02JECJ2.22.21.B10.1.454.CMB.1.raw
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccggcgtccgggtctcctggactagtcagtcaccntctcctgccacgtggaaccagcagtgacgttggtacgttacaagtntcgtctccgtggtaaccacaccaccngcacaccgaccccaatcatgattangtacgtcaacgtacgcggaccgtcgtaacgggtcctgactcgtacttcgtctacggtcctactacgttacgcggtaccgaccgtaccggtcccctaccggtcgtacccgtccgtcgtcgggtacctaccggcgtagtacgggtaacggtagtacgggtaacgtcgtaacgttaacgtttaccgttaaggttccgtaactttaccgtaacgtaacgtcgtaaccggtaccgaggggttaacctacccgttaaaggttccgggttacggggttcggtaccgggtaaccggaacggtacgtaaccgggtccgtaacgtacccgggtcgttaacggaccgaccgtaccgaccggtcccgtaccgttacccggtacgttccgtaccttacccggtccccg

SEQ ID NO: 105947 - DNA, 744 bp, Homo sapiens
  misc_feature: GYAE6OF02GA5PG.22.21.B10.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcacgccctcctcactcgagggcacgagggtccgtcgggaccagtctcgccctgactcacgtccctccctcgtccggtccggtcctcgngacgngtcacgtccacctatcctctcgcacgtacgaaccngcgagtgtacggttgtagtaactaagtntcgtctccgtacgtaaccaaacaaccgaaccgtacgaaccaaccccgtaaaccccaaacgtctacgtagttaactttagtacggtacgaccgtaacgtaaccggcccggtcccgtacgggtacggggtcccttagtaccgttccgtcctttaccgtcgtaccggtccctaactacgtccgtacggaaaccgtaacgcccgggtacccttcccgtaacggttacccgttcggtaccggttccggaccgtacccgtgggtccgtaggacggtagtcggcggttactagttacgtttagtactgacgtcgtatacgtaggtgtacgggactgaacgttcgtaagtttggtcgttgggtacggaacgggacgtaacgtaacgtccggtaccggtacgttaacggtcgaaaccgtaccggttacccggtcgtcccgtacccggtcccgtacccgttaccgttacccgttccgtaacccccg

SEQ ID NO: 105948 - DNA, 775 bp, Homo sapiens
  misc_feature: GYAE6OF02JF7LH.22.21.B10.1.454.CMB.1.raw
  modified_base (163)..(163): a, c, t, g, unknown or other
  misc_feature (163)..(163): n is a, c, g, or t
tcagacatacgcgtcacgaccggtgctcgatttagtgtcgtcgcaagggggggtctcgaggaggcagcgctctcaggacgtcaccaccatggcctgggctctgctcctcctacagtcctctcactcagggcacgaggctcctgggactcagtctgcctgactnagcctcgactcagtcgtccggctccgaggacaggtcacgtcaccatcgtaccacgacgtacggaaccagtccagtagtaacgtggttcgtaggttaactaacgtatcgtaccgtcgtacggtaaccaacgacgaccgaaccgtacggaacgtaaacccggccccctaacggaaccttcaacttaccgtaattttaccggactcctacgtaacgtaaaccgtaaacgtccggtaacccgtcggtaaaccggggtcccttaagccgttacgttccgttacttaccggtcgaccttaacggtaaaccgttccgggtaacctaccggtaaacttccggttaccggtaccgttaccccgtacggtaactcctttccggacgtaccggtactcgttacgggacttcgggaaacgttacgtacggtaagtctaacgggttacttaaaccgtcggtagtaacggtcctaaacgttcgtactttacccggaggttacccgtaccggtacgttaaccgttcgggttaccggtttaaccggggttccggaagggtaacccggtaccgtaacggtcccgttaacgccggtttaccgtaacggccgtacccgggacttaacccgg

SEQ ID NO: 105949 - DNA, 662 bp, Homo sapiens
  misc_feature: GYAE6OF02IO77C.22.21.B10.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctcgccctgactcacgccctccctccgcgtccgggtctccgtggacngtcagtcaccatctcctgccatcgaaccagcagtgtacgttggtagttacaagtntgtcctccgtaggtaccaactacccaccacggcaaccgaccgacccccaaactcaacttgtaatttagtacggaggtaccaacgtaacggccggtccgtaccggtacgggtcccctagactcgtcttctcgtcgtctaccgtagtctcggcgaccgaccgtcctccgtcgtacccgtctaccggtcgggcctccggacgtaccgtgggaaggtacgtaggacggtcttaggtaacttttagttaacctcgtacctacttccgtaatctggacgtacgggccgacttaacgtccggtttagggttcggtacgggcggtaacgaccgtagcgtacccggtcgccgttaacggccgaccggtaccgaaggttcccgtcccggtcccgttaccggtcctaccggtccttccccgg

SEQ ID NO: 105950 - DNA, 724 bp, Homo sapiens
  misc_feature: GYAE6OF02HIUFI.22.21.B10.1.454.CMB.1.raw
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacagtntgtctctggtacaacgcgcaccaggacaacgccccagactcatcatttangctgtactaagtaacgccggccctgtacggggtcccagtacgtcgtactttctcgtcggcctaccgtaagttcacggaaccaaccgtaccggtcccttacccgtacgtaaccctacgttccgtccggtaccgggtcccttaccggagggtccgttaacgggaaaggtaccgtacgggacggttaccgttaggttaaacgttttacctttacgtcggttacgttacgtccctttaggttaacgtttcggaaccgggtaccggttcccgttaacccgttacgttacgggttttacgggggttccggttaccggggaccgggtacgggtaaccctaacgggttcccggtaccggttaacccggttacgttaccggaccgtaccgggtaccccgtaagggtcccgttacccccgtcccccggtggttacccc

SEQ ID NO: 105951 - DNA, 649 bp, Homo sapiens
  misc_feature: GYAE6OF02IFZKA.22.21.B10.1.454.CMB.1.raw
  modified_base (261)..(261): a, c, t, g, unknown or other
  misc_feature (261)..(261): n is a, c, g, or t
tcagacatacgcgtcacgaccggtgctcgatttagtgtcgtcgcaagggggggggtctcaggaggcagcgctctcaggacgtcaccaccagtggcctgggctctgctcctcctcagcctcctcactcgagggcacgagggtcctgggcccagtctgccctgactcacgtccctcccgtccgcgtccgggtcctccgtaggacagtcagtccaccatcctcctgcacgtcggaaccagctagtgtacgttggagttacagtntgtcctcgtacggtaccaaccaccaccgagccacaccgacccccaaatcatgtacttagtgacgtcaagtacgccggtacctcggacgggtccctgtactcgtcttactcgtcgtcctacacggtctcgacgtaccgccggtccctaccgtcgtacccgttctcggtcggtaccgtccgacggtcgtcggaaggtcgtaggacgtacgttagtactttacttacgtcgttactactacgtactgtacgtcgacggaccgtactacggttcggttggttacgtcgggacggacggtaccgacgtacgtacggtaccgtcgtaaccgtcgaacccgacccgaacggtccacccggtccccgtaccggtcccgtaccgttcccgttccccg

SEQ ID NO: 105952 - DNA, 616 bp, Homo sapiens
  misc_feature: GYAE6OF02GPFQG.22.21.B10.1.454.CMB.1.raw
  modified_base (243)..(243): a, c, t, g, unknown or other
  misc_feature (243)..(243): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcactggaaccagcagtgacgttggtgttacaagtntgtctctggtaccacaccaccagcacacgacccccaaactcatgtattatgaggtcaactaagcggcctcgacgggtcctgatcgcttctctcggcctacagtcgtggcgacgcggccctccgtcgaccgtcctcgtcgggcctccgtaggcctaggaggacgtaggcggtctacggtaatttacttacgtagtccttactactattactcgacgtacggccgtacgtaacgttcggtttcggggttacgttccgggacgggtaacggaccgtaacggtcgtccggacccggttacgtaacgggtccaaccggtacccgaacggtcccgttacccggtccccccgttggtacccttaccgtcccttaccccgg

SEQ ID NO: 105953 - DNA, 806 bp, Homo sapiens
  misc_feature: GYAE6OF02HWNFD.22.21.B10.1.454.CMB.1.raw
  modified_base (138)..(138): a, c, t, g, unknown or other
  misc_feature (138)..(138): n is a, c, g, or t
  modified_base (145)..(145): a, c, t, g, unknown or other
  misc_feature (145)..(145): n is a, c, g, or t
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagacatacgcgtcacgaccggtgctcgattttagtgtcgtcgcaagggggggggtctcaggaggcagcgctctcaggacgtcaccaccatggcctgggctctgctcctcctcacgcctcctcactcgagggcacgngggtccncgggcccagtctcgccctgactcncgccctcctccgcgtccggtctccgtggacngtcacgtccacatcctccgtgccacgtcggaaccngcaggtgtacgtttggtacgttaacagtctcgtcgtcgtacgtaaccaaccaccgaccgaggacctaccgaacccgaacccccctaaatctacgttacgttaactttacgtacggtacgtaacctacgggttaaccggccgggtaaccgtccggggtacccggggttaccctaggttaccgttccgttccgttaaccgttcggtccggtacccttaccgtaacggttccggttacggacccgtaaccggtcccggtcccttacccgtacggtacccggttcgtccggtccgggtacctacggcgtcgagggtagacgtaggtaacgtcttacgtaagtttacttcgtaccgtaccgtacttactaacgtggtacccggtaggtaccggtaccggtacccttaacggggtttccgggtttaacggggttccgtacccgggggtaacggaaccggtaaccgtaccggtccggtaaccgttccgggtaaccgttaccggaccggtaccggtacccggtaccggtcccgtacccggtaccccgttacggtcccttccggtttcccgttaccccgg

SEQ ID NO: 105954 - DNA, 843 bp, Homo sapiens
  misc_feature: GYAE6OF02IXFUZ.22.21.B10.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (377)..(377): a, c, t, g, unknown or other
  misc_feature (377)..(377): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgccctccctccgcgtccgggtctccgtggacngtcacgtccacctctcctcctcgaccacgtacgaaccncgcgtagtacggtacggttggttacgttaacaagtatcgtcctccgtcgtaaccaaccacccaccgagaccaacgacccgacccctaactcattcgtatttacgtgtacgtaccgaacgtacggccggccgtcggaccggtccngtactccgtcgttccgtcgcgtcctacgtacgtcgacggccaccgtacccggtccctcccgtccggttacccgtccgtccgggttcggtcccgtaccggtacgggtcgtaacgggtacggtacgtcgggtaccggttacgttacggttaaacgttttacgttaccgttaacgttacccgtttaaccgttactaaacgttcgtaaccggaccgggtaccgggtacccgttaaccgtttacgggttttcccgggggtttcggggtttacccgggttacccggggggttaccggggtaaacccgggtaaccgtttaccgggacccgtttaaccgggttacccccggtttaacgggttaaccgggaaccccgtaacccggggtaacccggtccggttaccccggttaccccccgtacccccgggttccggtttaacccccttacggtttccccccgtttaacccccccgg

SEQ ID NO: 105955 - DNA, 155 bp, Homo sapiens
  misc_feature: GYAE6OF02IBE5G.22.21.B10.1.454.CMB.1.raw
  modified_base (116)..(155): a, c, t, g, unknown or other
  misc_feature (116)..(155): n is a, c, g, or t
tcagacatacgcgtcacgaccggtgctcgatttagtgtcgtcgcaaggggggggggtctcaggaggcagcgctctcaggacgtcaccaccatggcctgggctctgctctcctcacnnnnnnnnnnnnnnnnnnnnnnnnnnnnnnnnnnnnnnnn

SEQ ID NO: 105956 - DNA, 666 bp, Homo sapiens
  misc_feature: GYAE6OF02GFX65.22.21.B10.1.454.CMB.1.raw
  modified_base (323)..(323): a, c, t, g, unknown or other
  misc_feature (323)..(323): n is a, c, g, or t
tcagacatacgcgtcacgaccggtgctcgatttagtgtcgtcgcaaggggggggttctcgaggaggcagcgctctcaggacgtcaccaccatggcctgggctctgctcctcctcagcctcctcactcagggcacagggtcctgggcccagtctgccctgactcagcctccctcgcgtccgggtctccgtggaccagtccagtccaccgtatccgtcctagccacgttggaaccagcagttgaacttggtggttaccaagttactcgtctccgtggtacccaacaccaccgaggcctacgacgaccccaaatcaatctatttangacgtcactaacggccggcctcgacgggtcctgactcgtcttctcgtcggactaccgaagtcgtcggcgaacctccggtaccctccgtacgtacccgttctcgtacgggcccgtaccggtacggcggtacggaacggtacgtaggaacggtcttacgggttaatttacgttacgtacgtaccgttacgtactacgttacggtcgacggacggtacgtaccgtaaccgttggttacgggttcgttacggacgggtacgtacgacgtcggtacgtaccggttaccgacggttaccgactaccggacggtcctacccggcccggtcgtacctacgtccgttacccg

SEQ ID NO: 105957 - DNA, 716 bp, Homo sapiens
  misc_feature: GYAE6OF02GMNCD.22.21.B10.1.454.CMB.1.raw
  modified_base (149)..(149): a, c, t, g, unknown or other
  misc_feature (149)..(149): n is a, c, g, or t
  modified_base (279)..(279): a, c, t, g, unknown or other
  misc_feature (279)..(279): n is a, c, g, or t
  modified_base (500)..(500): a, c, t, g, unknown or other
  misc_feature (500)..(500): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctctcaactcgagggcacagggtcctgggcccngtctgaccctgacctgacgcctcccgtcgccggtccgggtctccgtaggacaggtccaagtccacctagtcctccgtaggcctacgtcgggaaccaggcctagtcgaccggtttggtcgttaacaaggtntcggtctccgtacggtaaccaactacccacccgtaggccacgacccgtaccccaaatcgaatcgtacttagcgacggtcacgtacggccggtcctcggacgggtccctgacgttcgtacttctacgcggtcctaccgtagtccgtgacccggacgccggtaccctccgtacgtacccgttcgtcggttcccgggactcccggaaggtcgtaacggcggtancgggtacgaccggttacgaacgttttactagtccgtacgttacctacgtattacggtaggcggaccggtacgtcgtacgtttcggtacgggttcgggttacggcggaagggtaacccgtagtccggtaccgtacccgggtacgttaccggtaccgacccggaaccggttcccggcttaccccgggccccgttggacccgttctacccggttccccg

SEQ ID NO: 105958 - DNA, 758 bp, Homo sapiens
  misc_feature: GYAE6OF02H4VO8.22.21.B10.1.454.CMB.1.raw
  modified_base (175)..(175): a, c, t, g, unknown or other
  misc_feature (175)..(175): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (258)..(258): a, c, t, g, unknown or other
  misc_feature (258)..(258): n is a, c, g, or t
  modified_base (577)..(577): a, c, t, g, unknown or other
  misc_feature (577)..(577): n is a, c, g, or t
  modified_base (739)..(739): a, c, t, g, unknown or other
  misc_feature (739)..(739): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagccttcctcactcagggcacgagggtcctgggcccagtctgcccgtgactcacgccctccnccggcgtccggtctcctggacagtcngtccacatcncctgccacgtggaaccngcgtagtgtacggttggtaggttacaagtntcgtactccgtacgtaaccaacgacccaccgaggcctaccgaccgtaccccaaagtcacgttgacttttagacggtacgtacaaccgttacggccggtcccgtaggtaccggggtcctggtacctccggtacttccgtcgtcggtacccacgttacggtaccgtcggacccgaccggtaccggtcccttacccgtcggtacccggttccgttaccgtcggggtacccttaccggaccggttacggtacggaaggtaccgagggtacgtacttaagttacggtttacttaccgtggttacccttacgtactacggttacncggttacgggacggtaccgtacgttaccgtttcgggttcgggtaacggtcgggaccgggtaacggaccgttacggccgttaccggtaaccggttcggttaaaccgccgttaaccggacccggtaaggttccctaccccgggtaccccgtccggtttaacccnccgttacccggttcccccg

SEQ ID NO: 105959 - DNA, 805 bp, Homo sapiens
  misc_feature: GYAE6OF02JJ7FA.22.21.B10.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcgagggcacgagggtccgtgggcccagtctcgcctgactcacgcctccgtcgcgtccggtctcgtggacngtcagtcactntctcctgctacgcggaccagctagtcgtacggttggtacggttaacaggttatcgtccttccgttaggtaacccaaccgtaaccccaccgacgggacctaccgacccgaaccccctaaacgtctaagttacgtaactttacgcggtaacgtaccgtaacgtaacgggcccggtccgttacggtaccggggtcccttaggtaccttcggtccttctcggtaccgtaccgtacgtacggtccgtacgggacccgacggtaccgtcccttacccgtcggtacccgttccgtccggtcggtccctaccggcggtgtacggaggtacgtcggtacggtcgttaacgttattaccgttcgtacgtccttacgacgttaagtcgtaccggtaagtccgggtaaccgtaactttacggggtttcggtttacgggggtttcccgggtaccggggtaaccggggtaaccggtaacgtccgggtaccggttacccgggttacccggtaacccgggttaaccggtccggaaacccggttacccggtaccgggttccccgttaccccgggtacccgtccgggttaacccttcccgttacccggtttccccgg

SEQ ID NO: 105960 - DNA, 689 bp, Homo sapiens
  misc_feature: GYAE6OF02IEK5H.22.21.B10.1.454.CMB.1.raw
  modified_base (162)..(162): a, c, t, g, unknown or other
  misc_feature (162)..(162): n is a, c, g, or t
  modified_base (251)..(251): a, c, t, g, unknown or other
  misc_feature (251)..(251): n is a, c, g, or t
  modified_base (638)..(638): a, c, t, g, unknown or other
  misc_feature (638)..(638): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgacctnagcctcctccgcgtccggtctccgtggacagtcagtccacatctcctgctacgtggaaccagccaagtgacggttcggtagtacaagtntgtcctccgtacggtacaaccaccaccgagccacaccgaccccaactcaatgacttagtcgacgtacaacgtaacggccggtccgtacggtacgggttccagtacgtccgtccttcgtacgacgtccgttacgtaacgtccgtacggacctaaaccggtccggtacccgtacccgtacgtacccgttccttacggtcggtaccctaccgagggtaccgtacggttaaggagttacgggtacggacgttaacgttaaacgttttacgttacgttaaggcgttaacgacctacgtacgtaaagttcgggaacgtacgtacgaccgaattacggtttcggtacggtacggtacgggtacgaacgtacgcggtacgacccgttaaccggtntacccggagacccggtagaccgtccgaccccggtacgtccctacgttcccg

SEQ ID NO: 105961 - DNA, 868 bp, Homo sapiens
  misc_feature: GYAE6OF02IFXLO.22.21.B10.1.454.CMB.1.raw
  modified_base (239)..(239): a, c, t, g, unknown or other
  misc_feature (239)..(239): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctcgggcccagtctcgccctgactcagtccctccctcgcgtccgggtctacctggaccagtccaggtccacctatccgtcctgacacgttcggaaaccngctaaggtgtaccgtttgggtacgttaacaaaggttctggtccttccgtacggttaacccaactacccgaacccgagggcaaccacggacccccctaaactctaatcgtaacttttacgtcggtaaggtccgtaaacgttaacgggccggggtaccgttccggaacgggggttccccctagggtaacttccggtaccttttccgttaccggttcggtcccgttaccgtaaacggtccgttgggaaccgaccgacccggttacccctaccccgtaacggtaccccgttacgttaccgggtccgggtaccctaccgggtacggtaccgtcgggaacggtacgttagggaacggtaccgttacgttaacgtttacgttacgtacggttaccttaaccgttacgtaacgttactcgggttaccgaaccggggtacggtaacccgtaaccggtttcgggtttccggggttacgggtttaccgggggttaacgggaaccgggggttaaccctaacgggtaccggttaccggtacccgggttcccgtaaccgggtacggttacccgggacgttaaccgggtccgttcccgggtacccccggtacggttaccgttacccctacggtttaccccccgg

SEQ ID NO: 105962 - DNA, 659 bp, Homo sapiens
  misc_feature: GYAE6OF02JNLYX.22.21.B10.1.454.CMB.1.raw
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
tcagacatacgcgtcacgaccggtgctcgatttagtgtcgtcgcaaggggggggtctcaggaggcagcgctctcaggacgtcacaccatggcctgggctctgctcctcctcagcctcctcactcagggcacagggtcctgggcccagtctcgccctgacctcgatccctcccgtccgcgtccgggtctcctggacngtcacgtcaccattcnctgccagtgaaccagctagtgtacgtggtgtacagtatgtcctcgtacgtaccaacgacccaccgtacggccaaccgtacgaccccctaacgtcaagttcggttaacttagtacggacggttacctaaccggtacggccccggtccgtacgggtaacccggtccgtagtaccgtcggtaccttcgaccgtcgtctaccgtagtcgtacgcgaccgacgtccccgtcttcgacccgtgtcccggtagcccgtacggcgtcggtcggtcggacgtgtacggtcgtagtacttacgttaccgtacgtctacgttacgtactcgtacgcgtcggacgtacgtaccgtacggttcggtacggtcggtacggacgacgtacgcgtacggccgtaccggtactacgtacgtacgccggtcgtcccgtaccgtccgtcgtaccgtccgttcccgg

SEQ ID NO: 105963 - DNA, 632 bp, Homo sapiens
  misc_feature: GYAE6OF02I44PK.22.21.B10.1.454.CMB.1.raw
  modified_base (223)..(223): a, c, t, g, unknown or other
  misc_feature (223)..(223): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (393)..(393): a, c, t, g, unknown or other
  misc_feature (393)..(393): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactcggaaccngcagtgacgttggtggttaactaactatcgtcctccgtggtaaccaacaacacccaggaccaacgcccccaaatcatntatttangagtcactaggccgcctcgacgggtcctgatcgcttctgtcggctaccagtcgtcgacacgccggtcctccgtagtacccgttcnccgtggaccctccgagctaggagcgtggcggtctagtacttacttcgtcgactacgtcttacgacttaggacggtacgacgtacggtagtaacgttaggttttcgggttacgggttcgggaaccgggtaacgggtaaccgacggttcgtacgggacccggttccggtaacggtcggaaccgtacccggaacggtcccgtacccgtcccccggtagttcccgtaccgttccgttaccccg

SEQ ID NO: 105964 - DNA, 558 bp, Homo sapiens
  misc_feature: GYAE6OF01ATTA3.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctatttagaggtgtcccttgtcaagtgcagctggtggagtcgtgggggaaaggtggtcaaggccgggggggtccctggagactctcctgtgcagcctctggattccacctttccgttcctataccatgaactggactcccgccaggcctccgagggaggcgacgtggagtgggtctcatctattagtggtagaggtgattactacaactacgcagactcacgtgggacggcctattccacctatcctaccagacgaaccaacaacctaaagtaactttactagtactctagactaaagtggaacagcctagagacgccgacgacacggctgtctatacgtgtcgagaggtggttcggattagttcggaccgttagtcccagtctcccgg

SEQ ID NO: 105965 - DNA, 565 bp, Homo sapiens
  misc_feature: GYAE6OF01CGG31.49.42.D09.1.454.CMB.1.raw
  modified_base (464)..(464): a, c, t, g, unknown or other
  misc_feature (464)..(464): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgcttattttagaaggtgtcccttgtcaagtgcagctggtggagtcgtgggggaaagtggtcaaggccggggggtccctgagactctcctgtgcagcctctggattcaccttccgtcctataccatgaactggactccgccaggcctccgaggggagcgactggagtgggtctcattctattaggtggtagaggtgattactaacaactacgacagacctcacgtgggacgggccgtattccacccatcctaccgagacgaaccaaacaaccctaaagtaactttactgtatcgtanacaaatggacacgtcctggaacgtacgaccgaccgaacgacggctgttctaattacgtgtgcgaggtgtcgggtattagtcggccgtagcccagcgtaccg

SEQ ID NO: 105966 - DNA, 594 bp, Homo sapiens
  misc_feature: GYAE6OF01C9O0T.49.42.D09.1.454.CMB.1.raw
tcagagtcgagagacacgaccggtgctcgatttagacacatacgcagggaaagggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtggggggaaaggtggtcgaaggccggggggggtccctggacgactctcctgtgcacgcctctggattccacctttccgtcctataccatgaactggactccgccaggcctccgagggaggcgacgtggaggtgggtctcatctattaggtggtagtaggtgtaattactacaaactacgcagactcagtggacgggccgatcaccatctaccagagaacaacaccaaagtaatttactagttatactgactaaatggacacgccgtagacgacgaccggacacgacggtctacgttctaattacgtggttacgacggtaggtacgggtttacgggattacgtttacggacccgttacggtcccgaggtcgttaacccggg

SEQ ID NO: 105967 - DNA, 611 bp, Homo sapiens
  misc_feature: GYAE6OF01BMHR1.49.42.D09.1.454.CMB.1.raw
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
  modified_base (468)..(468): a, c, t, g, unknown or other
  misc_feature (468)..(468): n is a, c, g, or t
  modified_base (597)..(597): a, c, t, g, unknown or other
  misc_feature (597)..(597): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaaggtgtcccttgtcaagtgcagctgggtggaggtcgtagggggaaaggtggtcgaagggccgggggggtccctggagactctcctgtcgcagcctcgtggacttcaccttccgttcctataccatgaactggactcccgcaggcctccgagggcggcgtacgtgggaggtggtctcattctagttaggtggtagaggtntattacaacaactacgacacgtactcacgtgggacggcctattccgacctntccaccgagtacaacaaccaacgaaagttatttaccngttatccgtagactaaagtcggacctaggacccttaggaaccgacgacccgtagaccgtacgggtacttggtacccttaaggttaccgtggtcggacgtaggtacggttcggtattgtcgacccgttancccagtcctcccgg

SEQ ID NO: 105968 - DNA, 518 bp, Homo sapiens
  misc_feature: GYAE6OF01BS7RU.49.42.D09.1.454.CMB.1.raw
  modified_base (318)..(318): a, c, t, g, unknown or other
  misc_feature (318)..(318): n is a, c, g, or t
  modified_base (514)..(514): a, c, t, g, unknown or other
  misc_feature (514)..(514): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccggggggtccctgagactctcctgtgcagcctctggattcaccttccgttcctataccatgaactggatccgccaggctccagggnggcgactggagtgggtctcatctattagtggtagaggtgattacacaactacgcagactcactggagggccgattcaccatctccagagacaacaccaagaatttactgtatctgacaaatggacagcctagagagccgacgacacggctgtctattactgtgcgagtgttcgggatagttgaccgtagtcccagntccg

SEQ ID NO: 105969 - DNA, 637 bp, Homo sapiens
  misc_feature: GYAE6OF01BD2DN.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctgggtggagtcgtgggggaaaggtggtcgaagggccggggggtcctgagactctcctgtgcagcctctggattcaccttccgttcctataccatgaactggactcccgccacggcctccgagggacggcgacgtggagtgggtctcatctagttagtggtagaggtagtattactacaactacgcagactcacgtggacgggcctattcaacctatcctaccgagacgaaccaaacgaaccaaagtaattttaccgtagtactctagaactaaagtcggaactacgcccgtaggaacgaccgacccgaacgacgaccggtcttacgtacttacgttaccgtggtacggtaccggtaaggtacgggtttccgggtaatttacggttaccggtaccccggtttaacggtacccccgtaaggtaccgttaaccccggg

SEQ ID NO: 105970 - DNA, 547 bp, Homo sapiens
  misc_feature: GYAE6OF01DMSCK.49.42.D09.1.454.CMB.1.raw
  modified_base (347)..(347): a, c, t, g, unknown or other
  misc_feature (347)..(347): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaggtgtcccttgtcaagtgcagctggtggagtcgtggggggaaaggtggtcgaaggccgggggggtccctggagactctcctgtgcagcctctggattcaccttccgttcctataccatgaactggatccgccacggctccgaggggcggcgacgtgggagtgggtctnatctattagtggtagaggtgattactacaactcgcagactcacgtggacgggcctatccaccatctaccagacgacaacaacaagtaatttactgtatcgtagtacaatcgacacgcctagacgagaccgacgacgacggctgtctattacgtgtgagagtcggttacggattacgttcggccgtagtcccagtctccgg

SEQ ID NO: 105971 - DNA, 603 bp, Homo sapiens
  misc_feature: GYAE6OF01DUCU2.49.42.D09.1.454.CMB.1.raw
  modified_base (456)..(456): a, c, t, g, unknown or other
  misc_feature (456)..(456): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcgaaggccgggggggtccctgagactctcctgtgcagcctctggattcaccttcccgttcctataccatgaactggatccgccaggcctccgaggggacggcgacgtgggagtgggtctcatctattaggtggtagaggtgattactacaactacgcagactcacgtgggacgggccgtattccaacctatcctccaagacgaacaaaccaccaaagtaacttttacngttatcttagacaaatggaacagtccctaggacgacgacccgaacgacgaccggtcttacgtctaactttacgtggttcggacggtaggtaggtttccgggaatttacggttcggtacccggttagtccccgagtacgttacccggg

SEQ ID NO: 105972 - DNA, 699 bp, Homo sapiens
  misc_feature: GYAE6OF01C0SAD.49.42.D09.1.454.CMB.1.raw
  modified_base (320)..(320): a, c, t, g, unknown or other
  misc_feature (320)..(320): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccggggggtcctgagactctcctgtgcagcctctggattccaccttccgttcctataccatgaactggatccgccaggctccgagggngcgactggagtgggtctcattctattaggtggtagaggtgtattactacaactacgcagactcacgtgggacgggccgtattccgaaccctatcctacccgaagtaacggaacctaaaccaaccgtaaaggttaaacttttaccgtaggttaacttccgtagtaacctaaaagttcgggaaacctacgggaccccgttaggaacgggtaacggacccccgggtaaacgaacccgtaccggggtcccttagggttacccttaaacggtttaaccgttgggttacggacccggtaagggttacgggttttcccgggggaaatttaccgtttcggggaccccggtttaacggtaccccctaagggtaaccgttacccccggg

SEQ ID NO: 105973 - DNA, 670 bp, Homo sapiens
  misc_feature: GYAE6OF01BPRPV.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaacgtggggctccgcgttgggttttccttgttgtcttattttagaaggtgtcccttgtcagtgcagctggtggagtcgtagggggaaggtggtacgaacgggtcccgggggggtcctggacgtacctcgtccgtgtcgcacgtcctcgtggtacttccgtaccctttcccgttcctactaccatagaacgtggactcccgccgaggcctaccggagggacggcgacgtgggtagtcgggtctctactacttagttaggtggtaggtaggtataacttaactaacaactacgacacgtacctcgacggtgggacgggcctattaccacctactcctcgaagacaacaaccaacctaaagttacttttactagtacttaccgtagaactaagtgaactcgaccgtaggacgtacggaccgaacgaccgacggtcttacgttacttacgttacgtggtcggacgggtaaggttcgggttaaccggtaattcggttaccggacccggttaccacccgtaggtaccgttaccccgg

SEQ ID NO: 105974 - DNA, 673 bp, Homo sapiens
  misc_feature: GYAE6OF01A0TUJ.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaaggtgtcccttgtcaagtgcagctggtggagtcgtgggggaaagtggtcgaagggccggggggtcctggagactctccgtgtcgcagcctctggacttcctaccttccgttcctactaccatcgaactggactccgccaggcctccggagggacggcgacgtgggacgtcgggtctctacttcgttaagttaggtgggtaggaggttagtaactttaaccgtaacaacgttacgactaacggtacctaccgaacggttggggaacgggtcccgtaattcccaacccgtacttccgtacccgaaggtaacgaaaccaaacctaaccgtaaagttaacttttacgagttaactcgtacgaactaaagtcggaacacggtacctaggaacgtaccggaccgaacgacgacggcctggtacttacgttacgtggtcgacggtaggtacggttacgggaattcgttcggacccgttacggtcccagtccgtacccgg

SEQ ID NO: 105975 - DNA, 651 bp, Homo sapiens
  misc_feature: GYAE6OF01C0JX0.49.42.D09.1.454.CMB.1.raw
  modified_base (587)..(587): a, c, t, g, unknown or other
  misc_feature (587)..(587): n is a, c, g, or t
  modified_base (594)..(594): a, c, t, g, unknown or other
  misc_feature (594)..(594): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaaggtgtcccttgtcaagtgcagctggtggagtcggtaggggggaaaggtggtacgaagggcccgggggggtcctgacgcctctccgtgtgcagcctcgtggtacttccaccctttcccgtaccttataccatcgaactggactcccgcgacggcctaccggaggggacggcgtacgtgggaggttcgggtctcgtatcgttagttaggtggtagtacggtagtaacttaacgtaacaaactacgacacgtacctcgaacggtgggaacgggtcctacttaccaacctacttcctaccgaaagaacgaaccaaacctaaaccgtaaagttaactttacgtagttactctacgactaaagtcggaacacgtctagagacgaccgacgacgcgtctcgtactattacgnggtacgnggtacggttacggttcgggtaattacggttcgaccgttaccgccagtcgtaccccgg

SEQ ID NO: 105976 - DNA, 651 bp, Homo sapiens
  misc_feature: GYAE6OF01ECI2U.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaacgtggggctccgcttgggttttccttgttgctattttagaaggtgtcccttgtcaagtgcagctggtggagtcgtgggggaaaggtggtcgaacggccggggggtccctgagactctcctgtgcagcctcgtggtacttcctacctttcccgttacctactaccatagaactggactccgccaggcctaccgagggaggcgacgtgggagtgggtctcatctattaggtggtagaggtgtattactacaactacgcagtactacgacgtgggacggtccgtattccaacctatcctacaaggaacaaccaaaccaacccgtaaagtaacttttacgtagttactcgttacaactaaagtcgaaccagaccctaggaacggtacgacccggaacgaccgaccgggtcttcggttacttacgttacgttggtacgtacgggtacggttacgggttacgggtactttaaggttccggtaaccgttaccgtaccccgtagtaccgttacccggg

SEQ ID NO: 105977 - DNA, 650 bp, Homo sapiens
  misc_feature: GYAE6OF01DLVQF.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctatttagagtgtcccttgtcaagtgcagctggtggagtcgtagggggaaagtggtcgaaggccggggggtcctgaggactctcctgtgcagcctcgtggtattcacctttccgttcctataccatgaactggatccgcctaggctccgagggacgcgacgtggagtgggtctcatcttagttagtggtagtaggtgtattacttaacaaactcgcaagacctacacgtgggacggaccgtattccaacctatcccgtacgaagacgaaacctaaacgacctaaagtaacttttacgagttaatccgtagactaaaagtcgggaactggtaccctggaacggtacgaacccggaacgaaccgacgggtcttaggtacccttaagtttaacgccggttagacccggttaaggacggttttacccggggaatttaaccggttcggaacccggttaagttcccccgaaggtaccgttaccccgg

SEQ ID NO: 105978 - DNA, 790 bp, Homo sapiens
  misc_feature: GYAE6OF01CN3PC.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagcgtggtggagtcgtagggggaaaggtggtcaaggccggggggtccctgagactctccgtgtgcacgcctcgtggactttccacctttccgttcctactaccatacgaaccgtcgtccgtccgacgaccgtccgtacgggaagggcgacgtacggaggtacgggtcgttcacgtacttagttacggttaggtaggtaggttagtagttaacttaacgtaacgtaacgacacgtactaccgacgtacggtacgggtaccgacttacgtaacccacgttacctaccggtaacgaacgaaacccgtaaaaccaaacccgtaaaacgttaaacgtttttaaccgttaacgtttaccgttaacgttacggaacgttaaaacggtaacggttaaccgaacgggttaccctaacgggttaacggaaaccggttcccgggaaaccgttaacccggaaccggttacgttccgttaccggttaacgtttacgttccggttagggtaccggtaagggtacgggttttacgggaacgtttaagttccgggttacccgtaaccggttacccggtaaacgtcgtttacccggtaaaccccccgg

SEQ ID NO: 105979 - DNA, 671 bp, Homo sapiens
  misc_feature: GYAE6OF01D8AHC.49.42.D09.1.454.CMB.1.raw
  modified_base (252)..(252): a, c, t, g, unknown or other
  misc_feature (252)..(252): n is a, c, g, or t
  modified_base (584)..(584): a, c, t, g, unknown or other
  misc_feature (584)..(584): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctgggtggagtcgtagggggaaaggtggtcgaagggcccgggggggtcccngagactctcctgtcgcagcctctggtacttcctacccttccgttcctaactaccatcgaactggactcccgcacggcctccgaggggacggcgacgtgggaggttcgggtctcgtattcttaagttaggtaggtaaggtaggtagtaacttaacctaactaaaccgtaacgcaagacctcaacggtcgggaacggtccgtaacttacccaaccctacttacccctaccaacggtaacgaaaccgaaacctaacctaaagttaactttactacggtaactcgtagtaactaaagtcgacacgtacgtagaacgtacgaccggacgaacgacgntcgtacttactagtcgtcggacgtaaggtcgggttacggagttacgttacggacccgtttaacggccctaaggtaccttaccccggg

SEQ ID NO: 105980 - DNA, 619 bp, Homo sapiens
  misc_feature: GYAE6OF01CZWK1.49.42.D09.1.454.CMB.1.raw
  modified_base (467)..(467): a, c, t, g, unknown or other
  misc_feature (467)..(467): n is a, c, g, or t
  modified_base (496)..(496): a, c, t, g, unknown or other
  misc_feature (496)..(496): n is a, c, g, or t
  modified_base (514)..(514): a, c, t, g, unknown or other
  misc_feature (514)..(514): n is a, c, g, or t
  modified_base (558)..(558): a, c, t, g, unknown or other
  misc_feature (558)..(558): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgctattttagaggtgtcccttgtcaagtgcagctggtggagtcgtaggggggaaaggtggtacgaacgggtcccgggggggtccctggacgacctcctccgtgtgcacgccttcgtggtacttcctacccgtttcccgttccttactaccagtcgtaactggacctcccggccgacggcctaccggaggggacggccgacggtgggaggtcgggtctcgtattcgttagttaggtaggtagaggttatacttactaactaacgtacgcaagactcgacgtgggacggtccattcaccntcctacagacacaacacaagtactttacntactcagacaagtcgacncgtaccaggacgacgccgaacgacgcggcttagtcttagttcgnggtcgaggtaggtagggttacgggtattacggtcggtacccgtacgtcccagtctacccgg

SEQ ID NO: 105981 - DNA, 686 bp, Homo sapiens
  misc_feature: GYAE6OF01ANN38.49.42.D09.1.454.CMB.1.raw
  modified_base (261)..(261): a, c, t, g, unknown or other
  misc_feature (261)..(261): n is a, c, g, or t
  modified_base (527)..(527): a, c, t, g, unknown or other
  misc_feature (527)..(527): n is a, c, g, or t
  modified_base (554)..(554): a, c, t, g, unknown or other
  misc_feature (554)..(554): n is a, c, g, or t
  modified_base (580)..(580): a, c, t, g, unknown or other
  misc_feature (580)..(580): n is a, c, g, or t
  modified_base (608)..(608): a, c, t, g, unknown or other
  misc_feature (608)..(608): n is a, c, g, or t
tcagagtcgagagacacgaccggtgctcgatttagacacatacgcagggaaaggggagctctgagagaggagccttagccctggattccaaggcctatccactttggtgatcagcactgagcaccgaggattcaccagtggaacgtggggcctccggcgtttgggtttttccttgttgtcttagttttaggaggtcgttcccttgtcaagtgcagtcgtggtgagtcggtaggggaagtggtacgacgggtccggggtccngagactctcgtgtcgcacgtctgtcgtacttcctccttccgtactatacctatcgacgtgactccgcacgctcggagggacggcgtacgtggacgttcggtctactacgttgttaacgttaggtaggtacggagtttaagtaacttaaccgaaccgtaaaccgtaccgacgtaacgtccgtacgtaacggtagggacccggtacgtacttaccgactacgttccgaaccgagtaacaacccaactaaccgtaatttacttaccgtnttaacgtctagaaacgtagaccggtancgtacgaggacgaccgacccggtaanaccggcgtcgttgtacgtttacttacgnggtcggtacgtaacgggtcggtttacgtagtttacccgttcgggtacccccgttgaacccgtggttaacccgttcccg

SEQ ID NO: 105982 - DNA, 720 bp, Homo sapiens
  misc_feature: GYAE6OF01AWWB3.49.42.D09.1.454.CMB.1.raw
tcagagtcgagagacacgaccggtgctcgatttagacacatacgcaggggaaaggggagcgtctgagagaggagccttagccctggattcccaaggcctatcccacgttggtgatcagcactgagccaccgaggattcaccatggactggggctccgctggttttcctgtgcttatttagaggtcgtcccttgtcaagtgcagctggtggagtcgtagggggaagtggtcgaagggccggggggtccctggacgactcctccgtgtgcacgtccttcgtggactttccgtacccttccgttccttaactacccagtgaacgtcggactcccgcgacggtcctaccggaggacggcgtacgtgggagtcgggtctacgattcgttaagttaggtggttagtaggttagtaacttacctaactaacgtacgactaacggtacctaccgtaacggttcgggaaccggtcccgtaagttacccacccgtacgttcccgtaacccaggaaacccgaaaccaacctaaaccgaaagttacttttaacctagttactcgtacgaagtaactagggaacacgtcgacggaagaccggtaccgaacgaccgtacgtcgttcgttaccgttaacgttacggcgttaacgggacgtaagggttacggtttcgggtaaattaccggttccggtaaccggttacctaccccggtaagttccgtaacccccggg

SEQ ID NO: 105983 - DNA, 716 bp, Homo sapiens
  misc_feature: GYAE6OF01EPH1J.49.42.D09.1.454.CMB.1.raw
  modified_base (550)..(550): a, c, t, g, unknown or other
  misc_feature (550)..(550): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaagtgtcccttgtacagtgcagctggtggaggtcgtagggggaaaggtggtacgaacgggcccgggggggtccctaggacgacctctcctggtcgccacgcctctggtacttcctaccttccgttcctatacctatagaacgtcggactcccgccgacggtcctccggaggggacggccgacgtgggacgttgggtctcgagttcttagttaggtacggtaggtaggtagtattaacgtaactaaccgtacggctaacgtacctcgtacgtgggacgggtaccgtattaccgaaccctactcctaccgaagaacgaaccaaccacgtaaagtacttttacgagttactctagtaactaagtcgggtaacncggtacgtacggaggaaccgtacccggaacgaccggtaccggtacgttacgttacgttaacgttacggttcggtacggtacgggttaggttaacggggttacggttaagttaccggttacggtaccccggttaacggttccccgaaggttccggttaacccccggg

SEQ ID NO: 105984 - DNA, 767 bp, Homo sapiens
  misc_feature: GYAE6OF01AYT0M.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaaggttgtcccttgtcaagtgcagctgggtggagtcgtagggggaaaggtggtacgaacgggtccgggggggtccctggacgtacctcctcctggtgcagtcctcgtggtacttccgtaccctttcccgttaccttactacccagtacgtaacgtggacctcccggccgacgggtcctaccggtggggacggtaccggtacgtgggtacggttggggtccttacgtattacgttaagttaggttacgggtaaggtaggttagtaacgtttaaccgtaacaaacgttacggactaacgtacctacgacggttacggggacggacccgttaacttcccgaacctacttacccgtaccgaacggaaacaaacccaaacctaaccgtaaagttaacttttaacgtagttaactcgtaacgacgtaaagccggaacctacggtaccgtagggaaccggtaccggaacccggaaccggtaccgaccggtcgttacgttacttagttaccgtggtacgtagggtacgtagggttacgggtaactttacgggttaccgaccggttaaccgtaccggtaaggtccgttaaccccgg

SEQ ID NO: 105985 - DNA, 655 bp, Homo sapiens
  misc_feature: GYAE6OF01DY1UE.49.42.D09.1.454.CMB.1.raw
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (537)..(537): a, c, t, g, unknown or other
  misc_feature (537)..(537): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcgttgggttttccttgttgtcttattttagaaggtcgtccctttgtcaagtgcagcgttgggtggagtcggtaggggggaaaggttggtacgaacgggcccggggggtcctggacgcctctcctgcgcngtcctcgtggtacttcctacctttcccgttcctataccatcgaactggactcccgcacggctcgagggaggcgagtggagtcggtcntntctatggtgtaggaggtgtaacttacgactaacgtacggcaagtactcgaacgtgggacggtccgtaacttaccaccgtactaccgtaccgaaggtaaacaaaccgaaaccgtaacctaaaagttaacttttaacgtataacgttactagtaacgtaacgtcgaacncgtactacgaggaccgaccgaacgacgacgtcttacgtaccttagtacgttcgtacggtagagggtacggttacgggtatacggttccgacggtaccgttccacggtcttaaccccgg

SEQ ID NO: 105986 - DNA, 878 bp, Homo sapiens
  misc_feature: GYAE6OF01A2K5H.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcgttgggttttccttgttgcttattttagaaggtgtcccttgtcaagtgcagcgtggtggagtcggtagggggaaaggtggtacgaacgggcccgggggggtccctggacgtacctctccgtggtcgcacgcctcgtcggtacttcctacccgtttcccgttaccttactaaccctagttacggaaccgtcgggacctccccggaccgtacgggcccgtacccgggaacgggggtacggaccggtaccggtggggtacggttcggggttcctacgtaacttacgttaaggtttaggtagggttaaggtagggttacgtaacgtttaaccgtaaaccgtaaaccgttaaccggaccgtaacggtaacccgtacgtaaccggttacggggtaaccgggtacccgtaacgtttacccaacccgtacgttacccgttaacccgaaaggtaacccgtaaaacccaaaccgtaaaacccgtaaaagttaaacttttaccgtaagttaacttaccgtaacgtaacctaaagtaccggaacgtaccggtaccgtaaggaacccggtaaccgaccccggtaaacccggtaacgaccgggttaccgtttacggttaaccgtttaacgttaccggttcggtaacgggtaccggtaaagggttacgggttaccggggtaatttaccgggttaccggtaccccggttaaccgtacccgtaaggtaccgttacccccggg

SEQ ID NO: 105987 - DNA, 616 bp, Homo sapiens
  misc_feature: GYAE6OF01EO9GT.49.42.D09.1.454.CMB.1.raw
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (547)..(547): a, c, t, g, unknown or other
  misc_feature (547)..(547): n is a, c, g, or t
tcagagtcgagagacacgaccggtgctcgatttagacacatacgcagggaaagggggagctctgagagaggagccttagccctggattccaaggcctatccacttggtgatcagcactgagcaccgaggattcaccatggaactggggctccgctgggttttccttgttgctattttagaaggttgtcccttgtcaagtgcagctggtggagtcgtgggggaaaggtggtcaaggccggggggtccctgagactctctgtgcagcctntggnttccaccttcccgttcctatacctangaactggattcccgcaggctccgagggagcgactgggagtgggtctcgattctagttagtggtaagaggtagattacacaactacgctagacctcgactagggagggcccgtatttccgaaccctattccgtccgaagaacgaaccaaacacccaaagtaacttttacagttactcttagacaaagtcggaacacgtacctagaacgacggacccgaacgaccgtaggcctggtacttagtttaaccgnggttagacggaacgttaggttaccgggattacgttcgacccggttacgtaccccaggtacttacccggg

SEQ ID NO: 105988 - DNA, 829 bp, Homo sapiens
  misc_feature: GYAE6OF01C3DCW.49.42.D09.1.454.CMB.1.raw
  modified_base (200)..(200): a, c, t, g, unknown or other
  misc_feature (200)..(200): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggactgggctccgcgttgggttttccttgttgtcttagttttagaggtcgtccttgtcaagtncagtcgtgggtggagtcggtagggggaaaggtggtacgaacggggtcccgggggggttccctaggacgtaccttccgttccgtggtcgccgacggtccttcgtggtactttccctacccgttttcccgttacctacgtacctagtacgtaaacgtggacctcccgaccgtacggtcctccggaggggacggcccgacggtgggtacggtgggtcctacgtacttacgttagttaggtacggtagtaggttactaacttaacgtaacctaacgttaccgacgtaacgtacctacgaaccggtaggggaacgggtacccgttaacttacccgaaccgtaccgttaccctaccgtaaaggaaccgtaaaacccaaaccgtaaaccgtaaaacgtttaaccgttttaaccgtagtttaaaccgttaccgtagttaaaccgtaaacggttaccggaacctaacggtaccgttaacgggaaacggtacccggaacccggtaacgaacccgggtaccggttaaccgtttacggttaaccttaacggttacgtagggtacggtacggtaaggttacgggtttaccggtaatttacggttacggtacccgtttacgacccctaggtcccgttacccgg

SEQ ID NO: 105989 - DNA, 739 bp, Homo sapiens
  misc_feature: GYAE6OF01AKBFY.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaaggtgtcccttgtcaagtgcagctggtggagtcgtagggggaaggtggtacgacgggtccggggggtcctggagtacctcctccgtgtcgcacgcctcgtggacttcctaccctttccgttcctataccatcgaactggactccgccaggcctcgagggcggcgacgtgggacgtgggtctcgtatcgtagttaggtcggggtaagtagggttacgtaatttaaccgtaacgaaaccgttacggactaacggtacctaccgtaacggtcggggaaccgggacccgtaacgttacccaaccgtacgttacccttacccgaaggtaacctaaccgaaaccgaacccgtaaaggtaactttttaccgtagttacttaccgtactaacgtaacgtaggtaaccgtaacgtcccgtaaggaacgaccggtaacccggtaacgaaccggtaccggaccttacgttaccttacgttaccgttggaacggttacggaaggttacgggttaccggtaagttcggttaccggtaccggttaaccgtcccgaaggttccgttaccccgg

SEQ ID NO: 105990 - DNA, 777 bp, Homo sapiens
  misc_feature: GYAE6OF01DHWRQ.49.42.D09.1.454.CMB.1.raw
tcagagtcgagagacacgaccggtgctcgatttagacacatacgcagggaaagggggagctctgagagaggagccttagccctggattccaaggcctatccacttggtgatcagcactgagcaccgaggattcaccatggaacgtggggcctccgtcgttgggttttccttgttgtcttattttagaggttcgttcccttgtacaagtgcagctgggtggaggtcggtaggggggaaaggtggtacggaacggggtcccgggggggtcctggacgtactccttccgtggtcggcctaggtccttcgtacggttacttccttaaccccgttttccgttaccttaactaacctagtacgaaccgtggtacctcccgccgacggcctcggaaggggacgcgacgtggtacggttcgggtctcacttcgttaagttaggaggtaggtagtagtaacttaactaacaacgtacgcagtacctacgacgtgggtacggtaccgtaacttccgaacctactacctaccgaagaaaccgtaaaccaaaacctaaccgtaaaattaactttacgtacgttaactacgtaacgtaactaaacgtcggaaacgcgtaaccgtgggaacgacccgggtaacccggaaccggtaacccgtaccggtacttaacggttaccgttaaagtttaccgtagggtcggtaacggtaaggttacggggtttaccggtaagtttacggtccggttacccgggttaacgtaccccgtagggttacccgttaaccccgg

SEQ ID NO: 105991 - DNA, 698 bp, Homo sapiens
  misc_feature: GYAE6OF01A3BLA.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcgaaggccggggggtccctggacgactctcctgtgcagcctcgtgtattcaccctttccgtcctaatacctatacgaacgtggactccgcctagggcctccgagggacggcgaacgtgggacgtgggtctcacttctaagttaggtcggtaaggtaggtagtaacttaacctacgtaaacctcggacacgtactcgacgtgggacgggtccaattccaacgtatcctaccgaaggacgtaaaccaaacctaacctaaacgtaatttaccgtagttaaccttcgtacgaactaaagtcggaactcggacccttaggaacggtaaccggaccccggtaacgacccggtacggtaccttcggttacgttaagtttacccgtcggttacggacggggtaacggtcgggtttacgggtaatttaaccgggttccggtacccggttaaacgtccccggtaagtacggttaccccgg

SEQ ID NO: 105992 - DNA, 836 bp, Homo sapiens
  misc_feature: GYAE6OF01A6DPE.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttggtttccttgttgtctattttagaggtgtcccttgtcaagtgcagctggtggagtcgtgggggaagtcggtacgaagggtccggggggtccctggacgaccgttcctccgtggttcgccgacgtccctcgtaggtactttccctacccttttcccgttaccttaactaccagttacggtaaccgttgggaactcccggaccgtacgggtcccgtaccggaggggacggcggtacgtacgggtacgtcggggtacttaccgtaattaccgttaagttacggttaggttaacggtagggtactaacgtttaaccgtaacctaaacgtacggacacggtacctccgtaaggtccgggacgggacccttacgttacctaacccgtactacccgtacaacggtaaccgaacctaaaccggtaaaccctaaagttaaccgtttacttaacgtacgtttaccgaacgtaaacgtaacgtaacgggtaaccacggtaccggttacgaacggtaaccgggacccctaaaccgggtacccggtaaccgggtcccgttaacgttaccgtttacgttaacccggtgttaaccggtaccgggttaaggttaccgggtttacggaaccgttttaaccgggttacggtaaccccgggtttacccggtaaccccgtagggttaacccgttacccggg

SEQ ID NO: 105993 - DNA, 624 bp, Homo sapiens
  misc_feature: GYAE6OF01EMK8P.49.42.D09.1.454.CMB.1.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
tcagagtcgagagacacgaccggtgctcgatttagacacatacgcagggaaagggggagctctgagagaggagccttagccctggattccaaggcctatccacttggtgatcagcactgagcaccgaggattcaccatggaactggggctccgcttgggttttccttgttgctattttagaaggtgtcccttgtcaagtgcagctggtggagtcgtgggggaaaggtggtcaagggccggggggtcctggagactctcctgtgcagcctcgtggtacttccacccttccgttcctataccatgaactggactccgccnggctccgagggngcgacgtggagtggtctcatctagttagtggtagaggtgtattacactaacgtacgacagacctcgtacgtgggacggtccgattccaccctatcctaccgaagaacaccgaaacaccgtaaagtaactttactagtatcgtagtacaaagttcgactacgcgttagacggccgtaccggaacgacgtaccgggtctcggttaccttagttaccgtgtcgggtacgtaacggtgggttaccggatttacggtccggttacccggttacggtcccgtaaggtccggttaccccgg

SEQ ID NO: 105994 - DNA, 697 bp, Homo sapiens
  misc_feature: GYAE6OF01BPWZ2.49.42.D09.1.454.CMB.1.raw
  modified_base (680)..(680): a, c, t, g, unknown or other
  misc_feature (680)..(680): n is a, c, g, or t
  modified_base (688)..(688): a, c, t, g, unknown or other
  misc_feature (688)..(688): n is a, c, g, or t
tcagagtcgagagacacgaccggtgctcgatttagacacatacgcagggaaaggggagctctgagagaggagccttagccctggattccaaggcctatcccacttggtgatcagcactgagcaccgaggattcaccatggaacgtgggctccgcttgggttttccttgttgtcttagttttagaaggtgtcccttgtcaagtgcgagcgtggtggtagtcggtagggggaaggtggtacgaacgggtcccggggggtcctggagacctctccgtgtgcacggtcctgtcgtacttccgtacctttcccgttactactacctagtacgtacgtaggtaccgtcccggcgtacggcccgtaccgggagggacggcgacggtgggtaggtccgggttctacgtaacttacgttaggttaggtaggtaaggttaggtagtaacttaactaacgtaaccgtacgacgtagtacctcgaccggtaggaccggtcctagtcctactcacgttccaacgtagaaccgaaccaaacgtaaccgtaagtttaacctttatacgtactcgtaagaacttaacggtagaacctaggactaagggaaccgtacgcccgtaaaccgcgtaacgtcgttacgttataacgttcgtagacggtgtaagttcggttagtattaccggtcgacccgtntaacccgnggttacccg

SEQ ID NO: 105995 - DNA, 552 bp, Homo sapiens
  misc_feature: GYAE6OF01CEXHF.49.42.D09.1.454.CMB.1.raw
  modified_base (383)..(383): a, c, t, g, unknown or other
  misc_feature (383)..(383): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (543)..(543): a, c, t, g, unknown or other
  misc_feature (543)..(543): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactgggctccgctgggttttccttgttgctattttagagtgtccctgtcaagtgcagctggtggagtctgggggaaaggtggtcaaggccgggggggtccctgagactctcctgtgcagcctctggattcaccttcgttcctataccatgaactggatcccgcaggctccgagggagcgactggagtgggtctcgatctatagtggtagaggtagattaataactaaactacgcagactcacngagggcattcaccanctccagnaacaacacaanaatttacagtanctagcaaatagggacngacctgagagaccgacgtaccagggcctggtctattaacgtgtggccgaggtaggttaccggtagtaacgtttagtccggttacgttcccctaaccggngttacccgg

SEQ ID NO: 105996 - DNA, 614 bp, Homo sapiens
  misc_feature: GYAE6OF01BGKLB.49.42.D09.1.454.CMB.1.raw
  modified_base (268)..(268): a, c, t, g, unknown or other
  misc_feature (268)..(268): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (598)..(598): a, c, t, g, unknown or other
  misc_feature (598)..(598): n is a, c, g, or t
tcagagtcgagagacacgaccggtgctcgatttagacacatacgcaggggaaaggggagctctgagagaggagccttagccctggattccaaggcctatccacttggtgatcagcactgagcaccgaggacttcaccatggaactggggctccgcttggttttccttgttgctattttagaggtgtcccttgtcaagtgcagctggtggagtcgtgggggaaagtggtcgaacgggccggggggtcctgagctctcctgtgcagcctnggacttcaccttccgttctactaccatgaactggactcccaccgaggcctccgaggggacggcgacgtgggagtgggtctcatcgttataggtggtagnggtnattactacacgtacncagactacacgtgggacggcgtatccaactctcctaccaagtacgaaccaacaaccgtaaagtaactttacgtagtactcgtacgaactaagtcggactacgtacctaggacgtaccgaccggacgaaccacggtccttacgtacttacgttacgtggtaggtaggtacggttggttcgggtattacggttccggtacgttaccggtacccnggtacgttacccccgg

SEQ ID NO: 105997 - DNA, 807 bp, Homo sapiens
  misc_feature: GYAE6OF01ECA43.49.42.D09.1.454.CMB.1.raw
  modified_base (588)..(588): a, c, t, g, unknown or other
  misc_feature (588)..(588): n is a, c, g, or t
  modified_base (777)..(777): a, c, t, g, unknown or other
  misc_feature (777)..(777): n is a, c, g, or t
tcagagtcgagagacacgaccggtgctcgatttagacacatacgcagggaaaggggagctctgagagaggagccttagccctggattccgaaggcctatcctacgttggtgatcagcactgagcaccgaggattcaccagtaggaacgtgggacctccgtcgtttcgggtttttccttggttgtactttaagttttaggaaggttcgttacccttgtacaagtgcagtcgtggtggtagtcgggtagggggaaggtcggtacggaacggggtccggggggtcctaggacgtccgtccgtccgtgtcgcgacgtccttgtcggtacttccgtaccctttccgttacctaactacctagtacgtaacgtcggaccgtcccgccgtacggccgtaccgggaagggtacggaccgtacgggtcgggtacggttcgggtctcttagttacgtagttagggtaggtagtaggtagtaacttacaacgtaacgtacgcgtacgtaccgtacgacggtacgggaccggtccttactacccgacttacgtaccgtacggaaagacaacctaaaccgtaataaaccgtttatttacgngttaacttaccgtaaggaacctaaaggtccgaacgcgttaccgtaaggacgtaacccggacccgggtaacgaccgttaccgggtacttacgttaaccgtttaggttaccggtcggggtaccgtaaggggttaacgggtttaccgggtttacgtaaacgtttcgggttaaccccggacggttaaacccgnggttaaccggttcccggttaaacccccggg

SEQ ID NO: 105998 - DNA, 791 bp, Homo sapiens
  misc_feature: GYAE6OF01BFZ0U.49.42.D09.1.454.CMB.1.raw
  modified_base (689)..(689): a, c, t, g, unknown or other
  misc_feature (689)..(689): n is a, c, g, or t
tcagagtcgagagacacgaccggtgctcgatttagacacatacgcaggggaaaggggagctctgagagaggagccttagcctggattccgaaggcctatccacttggtgatcagcactgagcaccgaggacttcgaccatggaacgtgggggcctccgtcttggggttttccttgttagtcttaagttttaggaacggtcgttcccttgtcaagttgccagtcgtgggtggtaggtcggtagggggaaaggtggtacgaagggtccgggggggtacctggacgtactctccgtggtcgcacgcctcgtaggtacttacctacccgtttccgttacctactaccgtagttacggacttcggtacctccgtaccgacggcctaccggagggtacggcggacgtgggacgttcgggtactctacgttcttaagttaggtaggtaacggtaggttacgtaactttaaccgtaactaacgtacgactaacggtacctacgtacggtgggaccgggtacctacgttaccaacctacgttaccacccggaagtacgaaaccgtaacgaacctaaacggttactttactaggtactacgacgtaacgtaaacggtccgaaacgtcgtaaccgtaggtaccggaacggtaacccgacgtaaccgggacgtcgttacggttaccttaacgtttacgggnggtaccgggtaaaggtagggttaccgggttacgggtaaacttttacggtcccgggtaacccgtttaaccggtacccgtaggttacccgttaaacccccgggg

SEQ ID NO: 105999 - DNA, 855 bp, Homo sapiens
  misc_feature: GYAE6OF01CO7LO.49.42.D09.1.454.CMB.1.raw
tcagagtcgagagacacgaccggtgctcgatttagacacatacgcaggggaaaggggagctctgagagaggagcctagccctggattccaaggcctatccacttggtgatcagcactgagcaccgaggattcaccatggaacgtggggcctccgtcgttgggttttccttgttcgtacttattttaggaaggttcgttcccttgtacaagtgacacgcgtgggtggaggtcggtagggggaaggtggtacggaacggggccggggggtacccaggtacgtaccttccgtccgtgtcgactacgtcctcgtacggtacttacctacccgtttccgtaccttactacctagttacgacgtggtaccgtcccgaccgacggtacctaccggagggaccggtccgtacggtagggtacggtcgggtacctacgtacgttacgttaaggttaggtacggggtaaggtacgggttagtaacgttaaccgtaactaacgtaccgacgtaacgtacctacgtacggtagggtacggtacctacttaccgaacctagttaccccaaccggaagaacccaaccgtaaaccctaaacgtaaacgtttaacgttttactaggttaacctacggttaacgaaaccgttaaagccggggaaacttacccgggaacggttaacggaaaccgggaccgggtaaccccgaacgggtaacccgtccggggtaacctttcgggttaaaccttaccggtttcgtaacggggtaccgaacgggttaggggttaaccggtttccgggtaattttacccgggttacccgggaacccttaccgggtaaccccaaggggtttaccccttaaccccccggg

SEQ ID NO: 106000 - DNA, 798 bp, Homo sapiens
  misc_feature: GYAE6OF01A85ZE.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccagtggaacgtggggctccgcgttgggttttccttgttgcttattttagaaggtgtcccttgtcgaagtgcagcgtggtggagtcggtagggggaaaggtggtacgaagggtcccggggggtccctggacgtacctcgtcctgtcgcacgcctcgtggacttcctacccgtttccgttaccttactacctagtacgtaacgttcggaacgtcccgccgaacggtccgtaccggaagggggacggccggtacggtcgggagggttcgggttcctaccgtagttacgttaaggttaggtagggtaaggtacgggttagtaactttaacgacaaaccgttacacgtaacgtactaccgaacggttcgggaacgggtaccctagtttacccaaccgttcgtacccgtaccgaaaggtaacccgaaacctaaaccgtaaacccgtaaagttaattttaccggtagttaacgttcgtaaccgaaacgtaaacggtacggtaacctaccggacgttaggaaacggtcccgggaaaccgtaaccggtaccgtaacgggtccttacgttacgttaacgtttaccggtggacgtaccgggtaagggtaccggtttaacggaattttccgggtacccggttccgttaagccccggtaaagttcggtaacccccgg

SEQ ID NO: 106001 - DNA, 976 bp, Homo sapiens
  misc_feature: GYAE6OF01AUK3E.49.42.D09.1.454.CMB.1.raw
tcagagtcgagagacacgaccggtgctcgatttagacacatacgcagggaaagggagctctgagagaggagccttagccctggattccaaggcctatccacttggtgatcagcactgagcaccgaggattcaccatggacgtgggctccgcgttggttttccttgttgtcttagttttagaggttcgttcccttgtactagtgcagtcgtggtggtaggtcggtagggggtaaggttcgggtacgaacggggtccccgggggggttcctagggacgtaccgttccgtccgttggtacgaccgacggtcccttacgttacggtacttttcccgttaccccgtttcccgtttacccttactaacctagtacgtaacgtacggtaccgtccccgaccgtacggtcccgtaccggacggggaccggcggtaaccggtgggtacggttcgggttacctacgtagtttaacgtttaggtttaacggttaggggttaacggtacggttacggttaaacgtttaacccgtaaccgtaaacccgtaccggtaccgtaacgtaaccgttaccgtaacgggtacggggtaccgggtaacccgtactttaccccgtaaccgttacccttcccgtaaccccgaagggtaaaccccaaaccccgtaaaaccgtaaacccgttaaaagtttaacccggtttttacttaaacggtttaccttaaccggtacgttaaaccgttaaaggttaccgggaacccgttaacgggtaacccgtgggttaaaacccggaccggtaaccccggtaaccggtacccgacggtttaccggtttaccgtttaaccgttacttaacccggggtttcgggtaaacgtacccgggtttacgggggttaggttttaacccgggggttaaccttttacggttaccccggggacccccggttttaacccggaacccgtttaacgggttacccccgtttaacccccgggg

SEQ ID NO: 106002 - DNA, 582 bp, Homo sapiens
  misc_feature: GYAE6OF01E1UJJ.49.42.D09.1.454.CMB.1.raw
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (488)..(488): a, c, t, g, unknown or other
  misc_feature (488)..(488): n is a, c, g, or t
  modified_base (535)..(535): a, c, t, g, unknown or other
  misc_feature (535)..(535): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcgttgggttttccttgttgcttattttagaaggttcgttcccttgtcaagtgcagcgtgggtggagtcggtagggggaaaggtggtacgaacggggcccggggggtccctggacgcctcctcctggtgcacgcctgtcggattcctaccctttccgttcctagtaccatcgaactggactcccgccagcctcgagggngccgagtggagtggtctntattctagttagtggtagaggtgtattacactaacgtacgcagactcagtggacggctatccacgtatctacagacaacaactaccaaagtacttatgtactcgtagaactaagtcgaanccggtacgtacggagacgaccgacgacgacggtctgtacgtattcgngtcgtgaggtggttcgtattcgtccacggtactccagtcgtacccgg

SEQ ID NO: 106003 - DNA, 956 bp, Homo sapiens
  misc_feature: GYAE6OF01DMAWR.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggactggggcctccgcttgggtttcctgttgcttatttagaggtcgtcccttgtacaagtgcagtcgtggtggaggtcggtagggggaaggtgggtacgaaggggcccgggggtcctggacgtacctcgtccgtgtcggcagtccttcgtggtaccttccgtaccctttccgttacctacaccgtagtcgtaaccgtggtactcccgccgacggccgttaccggaaggggcggtaccgtacggtacgggtacgggttacgggtaccttaccggtacttacgtttaaggttaacgggttacgggtttaaggtaccgggtagttaaccttaacgtaaacccgtaaacgtacccgacgtaacgtaaccctacggaacggtacggggtaccggacccttaacgttaccccgtaaccttaccgtaccccgtaccggtaacgaaccgtaaacccgaaaccgttaaacccgtaaacgtttaaaccgttttacgtaacgtttaccgttaaaccgtacggtaaacggtaaacgttacgggtaaacgtaacgggttacccgtaacccgggtaacgggttaaccccggaaccccgggtaaaacgtaccccggtaacccgggttaacggttttaacccccggtttagtttaaaccccggtttaaccgggttaacgggttaccgggttaacccgggttaggggtttaaacccggggttaaaccggggtttacccgttttaaacccggggtttacccggttaaccccccggggtttaaacccgggttacccccgggttaaaaggtttccccggttttaaaccccccccggggg

SEQ ID NO: 106004 - DNA, 736 bp, Homo sapiens
  misc_feature: GYAE6OF01EVAJH.49.42.D09.1.454.CMB.1.raw
  modified_base (121)..(121): a, c, t, g, unknown or other
  misc_feature (121)..(121): n is a, c, g, or t
tcagagtcgagagacacgaccggtgctcgatttagacacatacgcgagggaaaggggagctctgagagaggagccttagccctggattccaaggcctatccacttggtgatcagcactgancaccgaggattcaccatggaacgtggggctccgcgttgggttttccttgttgcttattttagaaggttcgtcccttgtcaagtgctagcgtgggtggaggttcggtagggggaaaggtcggtacgaacggggtcccgggggggtccctggacgtacctctccgtgtgcacgcctctggtacttccgtaccctttcccgttacctactacctagtacgtaacgtggtaccgtcccggccgacggtcccgtaccggaggggcggaccgacggtacgggtaggtcgggttcctacgtacttacgttaaggtttaggtgggtacggtaggttgtaatttaaccaacgtacgttaaccgctaacgtacctaccgtaacggtcggggacggtacccgtagttacctaacccgtactccgtaccgaacggtaaccgaaaccaaacctaaccgtaaacgttaacttttaacgtacgttactacgtacgtaactaaggtcgaacgaccgacgtaggacgtacggaccgacgtaccgcggtacttcgtacttagttacgtcggtagacggtacggtaggtacgggttatacggttacgtaccgttacgcccgtagtcgtacccgg

SEQ ID NO: 106005 - DNA, 855 bp, Homo sapiens
  misc_feature: GYAE6OF01CB08S.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggatcaccatggaactggggctccgcgttggtttccttgtgcttagtttagaggtcgtcccttgtcaagtgcgagtcgtgggtggaggtcggtaggggggaaaggtcggtacgaacggggcccggggggttcctggacgtaccgtcctccgtggtcgacgtacgtcctcgtaggtacttcctacccgtttccgttacctaactacctatacggacctggacgtcccgacgacggcctaccggagggtacgccggtagtcgggtaggttcggtcctagagttacgtttaagtagggttaggtaacggtaggttaacgtaacgtttaacctaaccgtaaaccgtaccggacgtaacggtacctaccgtaaccgggtacgggtaaccgggtaccccgtaactttacccaacccggttactcccggtaacgaaacgggaaacctaaaccaaaccctaaaacgttaaacgtttaaagttttacccgtagttaacccgttacgtaacggtaaaacccgtaagggttaaccggaaccggaaccgtttacccgggtaagggtaaccggtaaaccccgggacccgaaacggtaaccccggtagggttaacccctttaaggttacccgtttaaagttaccgggttacggtacggaaccggtaagggttcggtttaaccggtatttacccgggtcgtacccggtaaccgttaccccgaaggttacccggttaacccccgg

SEQ ID NO: 106006 - DNA, 849 bp, Homo sapiens
  misc_feature: GYAE6OF01CBF0J.49.42.D09.1.454.CMB.1.raw
  modified_base (632)..(632): a, c, t, g, unknown or other
  misc_feature (632)..(632): n is a, c, g, or t
  modified_base (642)..(642): a, c, t, g, unknown or other
  misc_feature (642)..(642): n is a, c, g, or t
tcagagtcgagagacacgaccggtgctcgatttagacacatacgcagggaaaggggagctctgagagaggagccttagccctggattccaaggcctatccacttggtgatcagcactgacgcaccgaggattcaccatggaacgtggggctccgtcgttgggttttccttgttgcttagttttagaaggttcgttcccgttgtacaagtgctagcgtggtggtagtcggtagggggaaggtggtacgaacgggtcccggggggtacctggacgtactcttaccgtgtagctacggccttacgtggtactttccgtacccgttttacccgttaccttaacttaccagttaacgtaaccgttcgggaccttcccggacccgtacgggtccgtacccggtaagggggacggaccgtaccggtggggtaacggttcgggtcttacgaagtttaccgttaaggtttacgggttaggttaaacggtacggtagttaaaccgtttaaacgtaacccgtaaacgttaacggaccgtagtaacccgtctaacggttacgggacgggtaccgttactaccaacctactccgtaaccgacgtaagaaccctaacgaaccgttaaagtaacttagttacgttanaccggttaanaacgtaagtaccggactacggtacgtaacggacggtaccggaacccggtaacgaacccggttaccggttaacgtaaccgtttacgtaacgtttaccgggcggttaccggaacggttacgggtttaaacgggttacccggttaagtttcgggtttcccggtaaccccgggttacgttaaccccggtaaggttaaccccgttacccggg

SEQ ID NO: 106007 - DNA, 769 bp, Homo sapiens
  misc_feature: GYAE6OF01BK6M4.49.42.D09.1.454.CMB.1.raw
  modified_base (151)..(151): a, c, t, g, unknown or other
  misc_feature (151)..(151): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggactgggctccgnttggttttctgttgcttattttagtaaggtgtcccttgtacaagtgcgagcgtggtggacgtcggtagggggaaaggtggtacgaacgggcccggggggttcctaggtacgaccgttctccgtgtcgaccacgccttgtggtacttcgtacccttccgttactaactaccattacgaacttcgggaactccggacctacggtcctaccggaaggggacggaccgtaagttaggggtaacggttcgggtccttacgtaagttactttaaggttttagggtacgggtaggtaacggttagttaacttaaccgttaaaccaacgttaccgacgtaagtaccctaacgaacggtcggggacgggtaccctacgtttacccacgttactaccgtaccgaaggtacaaaccaaccgtaaacaagttaacctttaaggtcttacgtactaggaacttaagacgggtaacaacggtctaggaacgacgggtccgaacgtaaccggcgtacctcgtttaacgaacctttagttacggaccggtacgggtaacgtggggttttacccgaaagttttacccggttacgacccggttttaacccgacctaggtaaacccgttaccccggg

SEQ ID NO: 106008 - DNA, 803 bp, Homo sapiens
  misc_feature: GYAE6OF01DBK6J.49.42.D09.1.454.CMB.1.raw
  modified_base (190)..(190): a, c, t, g, unknown or other
  misc_feature (190)..(190): n is a, c, g, or t
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
  modified_base (632)..(632): a, c, t, g, unknown or other
  misc_feature (632)..(632): n is a, c, g, or t
tcagagtcgagagacacgaccggtgctcgatttagacacatacgcaggggaaaggggagctctgagagaggagccttagccctggattccaaggcctatccattggtgatcagcactgagcaccgaggacttcaccatggaacgtggggctccgcgttgggttttccttgttgcttatttaggaaggttntcccttgtacaagtgctagcgtgggtggnggtacggtaggggggaaaggttcggacgaacggggcccgggggggtccnggacgtactcgtcctggtacgctacgtccgtgtacggttacttccctaacccgtttcccgttacctaacttacccagttaacgacgtacggtacgtcccgacgacggtccaccggaggtacggcgacgtgggacgttggtacctgtatcgttattgggtaggtacgaggtacgtaacttaactaacaacgttacgactaacggtacctaccggaaggttcggggaacgggacccttagtacccgtaaccacgttcccgtaacgaaacggaaccgaaaacccaaactaaacccgtaaaaaggttttaacctttaccgtaagttacccgttaaccgtaagtaaacccgtaaaggcggtaaacccgnggtaacccgtaaggaaaccgggacccttacccgggaaccggaacgacccgtcgtttaacgtacttacgttaaggtcgggtaacggaccgggtaaaggttttaccgggacggtaatttccggtttaccggacccggttaacgtacccggtaagttaacccggtaaccccggg

SEQ ID NO: 106009 - DNA, 790 bp, Homo sapiens
  misc_feature: GYAE6OF01C0EJR.49.42.D09.1.454.CMB.1.raw
  modified_base (598)..(598): a, c, t, g, unknown or other
  misc_feature (598)..(598): n is a, c, g, or t
  modified_base (773)..(773): a, c, t, g, unknown or other
  misc_feature (773)..(773): n is a, c, g, or t
tcagagtcgagagacacgaccggtgctcgatttagacacatacgcagggaaagggggaggctctgagagaggagccttagccctggattccaaggcctatccacttggtgatcagcactgagcaccgaggattcaccatggaactggggctccgctgggttttcctgttgctattttagaggtgtccttgtcaagtgcagctggtggagtcgtgggggaaagtggtacaggccggggggtcctggacgactctccgtgtgcagtccttcgtggtacttcacctttccgttcctataaccatcgtaaacgtggaaccttcccgaccgacggtacctaccggtaacggggacggaccgaccggttaggggacggttcgggtccttacagtcctttaaggttacggtggggttacgtaagggttacgtaacgtttaaccgtaacaaaccgttacgggacctaacggtaccgttactaaccggtaggggtaaaccgggggtcccgttaacttttcccgaaaccctacgtttacccgttacccgaaaggtaaccggaaccaaaaccgtaaaccgtaaaagtaactttttaacgtaacgtttanaccgttagtaaaccgaattacgggaactacggtacccgttaggaaaccggtaaggtcccgaaccggtaacgaccggttgttaccggttacgttacttacccgggttggtccgggtaggtaagggtacgggtttaccgggaattaggtttccgggacccctttaggggtaaccccnggttaacctaccccggg

SEQ ID NO: 106010 - DNA, 830 bp, Homo sapiens
  misc_feature: GYAE6OF01CBT8B.49.42.D09.1.454.CMB.1.raw
tcagagtcgagagacacgaccggtgctcgatttagacacatacgcagggaaagggagctctgagagaggagccttagccctggattccaaggcctatccacttggtgatcagcactgagcaccgaggattcaccagtggacgtggggctccgtcgttgggttttccttgttgctttagttttagaaggtgttcccttgtcgtaagttgcctaggcgtgggtggagttcggtagggggaaaggttggtacgaacggggtcccggggggttcctaggacgtaccttccgtccgtggtcgacgtacgccgttcgttcgtacctttcccgttacccgtttacccgttaccttaaccgtaaccgtagtagtaaccgttacggacccgtcccggtcccggacggtccgtaccggggaaggggcggacggtacggtgggtcggttcgtcgtctacgttactttaggttaggtaggttaggtacggttacgttaactaaccgtaactaacgtacgacgtacgtacgtacgagggtacgggacggtacccttacgtcctaccgtaccttaccgtacgaacgaaccgaaccgaaacgtaacgtaacgtttaactttactacgttcgtacgtaagtaacgtaacgtaacggtacgaccggtacggtaacggaacggtacccgaacccggtaccggtaccgtaccgttacgtttaccgttaccgtttacgttaccggtacggtacgggttaaagggttacgggttacggttcggtttaaacccgttcggtttaccgggtaaccccgttaccggttacccggtacgttaccccgggttacccg

SEQ ID NO: 106011 - DNA, 861 bp, Homo sapiens
  misc_feature: GYAE6OF01A0SN1.49.42.D09.1.454.CMB.1.raw
  modified_base (213)..(213): a, c, t, g, unknown or other
  misc_feature (213)..(213): n is a, c, g, or t
  modified_base (687)..(687): a, c, t, g, unknown or other
  misc_feature (687)..(687): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggcctccgcgttgggttttctgttgcttagtttagaaggttcgtcccttgtacaagtgcagcgtgggnggagtcggtagggggaaggtggtcgaacggggtccggggggtcctgacgtacttcgtctgtgcgacgcctgtcggtacttccctacccgtttccttaccttacctaccagtacgacgtggtactcccgccgacggcctccggagggtcggcgtacgtgggtaggtcgggtctcgtacgttcgtaagtaggttacgggtaggaggttgtaacgttaacctactaaaccgtacgctaaggtacctaccgaggtaggggaccgggtaccgtactttaccgaaccctacgttacccgtaccgaacggaaccgaaacccgaaaaccccgttaacgtaaaacggtttaaacctttttacccgttaggtttaaacctttccgttaacggaaaccgttaagggtacccggaaccgtaaccggaccgttacgggaaaccgggtacccgggtaccccgtaaaaccggggcccaacccggggttnttttaacccggtttaccgtttaaacgttttaaccgggacggggtttacgggaacccgggtttaggggttaaccggggttttacccgggggaaatttttacggggttaacccccgggtacccggtttaaccgggacccccgggtaaggtttaaaccccggttttaacccccgggg

SEQ ID NO: 106012 - DNA, 685 bp, Homo sapiens
  misc_feature: GYAE6OF01BOBNC.49.42.D09.1.454.CMB.1.raw
  modified_base (495)..(495): a, c, t, g, unknown or other
  misc_feature (495)..(495): n is a, c, g, or t
  modified_base (560)..(560): a, c, t, g, unknown or other
  misc_feature (560)..(560): n is a, c, g, or t
  modified_base (578)..(578): a, c, t, g, unknown or other
  misc_feature (578)..(578): n is a, c, g, or t
  modified_base (605)..(605): a, c, t, g, unknown or other
  misc_feature (605)..(605): n is a, c, g, or t
  modified_base (623)..(623): a, c, t, g, unknown or other
  misc_feature (623)..(623): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaaggtgtcccttgtcaagtgcagcgttgggtggagtcgtggggggtaaaggtgggtacgaaggggtccgggggggtccctggacggacctccttccgtggtcgacgacgcctgtcgtaccttccttacccgttccgttacctactactagtacgaacgtcggaccgtcccgaccggacggccgtaccggagggacgcggtacggtgggtgggtcggtctatacttactagttaggtaggtacggaggttactaattaaccaaactaccgaacgcgacgtacctcgacggtgggaaccggccttactccaacttcnccgtaacgacggaaacaacccgaaaccaaacgttaaacgttaactttaccgttataacttggaanaaaccgttagaccggtanaccgtcgagacggaccgccgaacgacnggtacctgttacttacgngttaggcgacgggtgtaccggtttgatttaccggcggtctaaccgtcgacgtcgtaccccgg

SEQ ID NO: 106013 - DNA, 520 bp, Homo sapiens
  misc_feature: GYAE6OF02HWI5V.49.42.D09.1.454.CMB.1.raw
  modified_base (410)..(410): a, c, t, g, unknown or other
  misc_feature (410)..(410): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccgggggggtccctgagactctcctgtgcagcctctggattcaccttccgttcctataccatgaactggatccgcaggctccgagggaggcgactgggagtgggtctcatctattagtggtagaggtgattacacaactacgcagactcactggagggccgattcaccatctccaganacaacaccaagaatttactagtatctagcaaatggacagcctgagagccgacgacacggctgtctattactgtgcgagagttcggattagtgccgttagtcccagatccg

SEQ ID NO: 106014 - DNA, 527 bp, Homo sapiens
  misc_feature: GYAE6OF02HPXS8.49.42.D09.1.454.CMB.1.raw
  modified_base (523)..(523): a, c, t, g, unknown or other
  misc_feature (523)..(523): n is a, c, g, or t
tcagagtcgagagacacgaccggtgctcgatttagacacatacgcagggaaaggggagcgtctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccgggggggtccctgagactctcctgtgcagcctctggattcaccttccgttcctataccatgaactggatccgccaggctccagggagcgactggagtgggtctcgatctattagtggtagaggtgattactacaactacgcagactcactggagggccgattcaccatcctcagagacaacaccaagtaattactgtatctgacaaatggacagtcctgagacgccgacgacgacggctgtctattactgtgcgagtgttcgggattagttcgccgttagccctagtntccg

SEQ ID NO: 106015 - DNA, 555 bp, Homo sapiens
  misc_feature: GYAE6OF02ISVCZ.49.42.D09.1.454.CMB.1.raw
  modified_base (432)..(432): a, c, t, g, unknown or other
  misc_feature (432)..(432): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggtttccttgttgctattttagaaggtgtcccttgtcaagtgcagctggtggagtcgtgggggaaagtggtcaaggccggggggtcctggagactctcctgtgcagctctggattcaccttccgttcctataccatgaactggatccgccaggctccgagggagcgactggagtgggtctcatctattagtggtagaggtgattacacaactacgcagactcacgtggagggccgattcacctatctaccagacaacaacaccaaagtaactttacngtactctagacaaagtggaacagtcctagaacgacgcccgaacgacgaccgggcttgtacctatttacgnggtcncggagtacggttacgggattacgttgaccgtacgtcccagtctcccgg

SEQ ID NO: 106016 - DNA, 542 bp, Homo sapiens
  misc_feature: GYAE6OF02JAW2C.49.42.D09.1.454.CMB.1.raw
  modified_base (319)..(319): a, c, t, g, unknown or other
  misc_feature (319)..(319): n is a, c, g, or t
  modified_base (537)..(537): a, c, t, g, unknown or other
  misc_feature (537)..(537): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggnggcgactggagtgggtctcatctattagtggtagaggtgattactacaactacgcagactcactggagggccgattccaccatctacagacgacaacaccaaagtaactttactagttactctagacaaagtggaacagcctgacgacgccgacgacacggctgtctattactgtgacgaggtagttcgggattacgttcggaccgtagtcccgagtntccgg

SEQ ID NO: 106017 - DNA, 560 bp, Homo sapiens
  misc_feature: GYAE6OF02I3EB6.49.42.D09.1.454.CMB.1.raw
  modified_base (320)..(320): a, c, t, g, unknown or other
  misc_feature (320)..(320): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccggggggatcccgtgagactctcctgtgcagcctctggattcaccttccgttcctataccatgaactggatccgccaggctccagggnggcgacgtggagtgggtctcatctattagtggtagaggtgattactacgaactacgcagactcacgtgggacggccgtattcgacctataccgtcaagagaacaaaccgaacaagtaactttacagtactctagacaaatggaactagccgtagacgacgaccgacgacacggctagtcctagttactggtacgacgaagtcggttacggaattagttcggacccgtagtcccagtaccg

SEQ ID NO: 106018 - DNA, 572 bp, Homo sapiens
  misc_feature: GYAE6OF02GUOEZ.49.42.D09.1.454.CMB.1.raw
  modified_base (361)..(361): a, c, t, g, unknown or other
  misc_feature (361)..(361): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaagtggtcaaggccgggggggtcctgagactctcctgtgcagcctctggattcaccttccgttcctataccatgaactggatccgccaggcctccgagggaggcgacgtggagtgggtctcattctattagtggtagaggtnattactacaactacgcagactcacgtggaggccgattcacatctccagagacaacacaagtaatttactagtatcgtgactaaagtcggaacagcctagaagacgacccgacgaacgacggactcgtcgttacttacgtggtacgacggtaaggtacgggtttaccgggagttacgttcggaccggttaacgtcccgtaggtacttcccgg

SEQ ID NO: 106019 - DNA, 571 bp, Homo sapiens
  misc_feature: GYAE6OF02HYE3E.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctgggtggagtctggggggaaaggtggtcaaggccgggggggtccctggagactctcctgtgcagcctctggattcaccttccgttcctataccatgaactggactccgcaggctccgaggggagcgactggagtgggtctcatctattagtggtagaggtgattactacaactacgacagactcactggagggccgtattcacctatcctaccagacgacaacaaccaagtaatttactgtatctagactaaagtcggacagtcctaggaagacggcccgaacgacgacggcttagtccttagttacgtggtggccgtaaggcggtttacgggattagttcggacccgttaggtccccaggtactccgg

SEQ ID NO: 106020 - DNA, 622 bp, Homo sapiens
  misc_feature: GYAE6OF02GA58U.49.42.D09.1.454.CMB.1.raw
  modified_base (266)..(266): a, c, t, g, unknown or other
  misc_feature (266)..(266): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaagtggtcaaggccggggggtccctgagactctcctgtgcagcctntggattcaccttccgttcctataccatgaactggactcccgccaggcctccgagggaggcgacgtggacgtgggtctcgatctattagtggtagagggtgattactacaactacgcaagactcacgtgggacgggccattccacatctccagacgacaacaccaagaactttactagtactcgtagacaaagtcggaacagtcccgtaggacgacggtacccggaaccgaaccacggtcgtacgttccgttaagttaccgtgggtacggtaccggtaagggtaacggtttaccgggggtaatttacggttacggtaccccggttaacggtcccccgtaaggtcccgttaccccggg

SEQ ID NO: 106021 - DNA, 547 bp, Homo sapiens
  misc_feature: GYAE6OF02F3MBC.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaagtgggtcaaggccgggggggtccctgagactctcctgtgcagcctctggattcacctttccgttcctataccatgaactggatccgccaggctccaggggacggcgacgtgggagtgggtctcatcgtattagtggtagaggtgattactacaactacgcagactcactggagggcatcaccatctccagagacaacaccaaagactttacagtatctagacaaatggacagcctagagagccgacgacacggctggtctagttactggtcgcggtagtaggttacgggtattaggttcggaccgttagtcccctaggtactccgg

SEQ ID NO: 106022 - DNA, 912 bp, Homo sapiens
  misc_feature: GYAE6OF02J3321.49.42.D09.1.454.CMB.1.raw
tcagagtcgagagacacgaccggtgctcgatttagacacatacgcgagggaaagggagctctgagagaggacgtccttacgcccgtggtacttaccgaacggtcctactccctacgttggtacgactcacgctacgtgacgaccgaccgagtactaccacgtagtacggtacgtcggtccttccgttcggttttcggtttccgttagttacgttacgtttaacgtttacggtacggttccttaccgttagtacgtagtcgacgtaggtcggtacgggtacggtacgggttacggggtaacggggtaacggtccgggtaccgggtaccgggggtcccgggttacctaggtacctccgttccgttcggtggtccgtaccgtaccgttccgttacgttaccgttaccttacccgttacccgttaccgttaacctaccgtacgtacgtaccgtccgtaccggtaccgtcccgtacggtacggtaccgacgggtacggtcggtacgtacggtacggtacgttcgtactaccgttacgttacggttaaggtacggtaagtacgtaacgttaacctaactaaccgaaccgtacgtaaccgacgtaccgtacgtaccgggtacggtaccgggtacctacctacaccgtaccgtacgtaccgaacgtaacgtaaccctaaaccgtaacttaaagttaacgttactacgttacgacgtaacgtacgtaacgtacgaccgtacggtaccgtaaccggaccggtaaccgtacccggtaccgtaacggtccttcggtacttacgtaaccgttacggtacggtcggtaacgggtttacctaacgggttaccggttacctaaccggtttcccggtaacccgggaccttaccggtaaccccgttaccggttaccccggtaaccccggg

SEQ ID NO: 106023 - DNA, 604 bp, Homo sapiens
  misc_feature: GYAE6OF02IU0YQ.49.42.D09.1.454.CMB.1.raw
  modified_base (358)..(358): a, c, t, g, unknown or other
  misc_feature (358)..(358): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcaaggccgggggggtccctgagactctcctgtgcagcctctggattcaccttccgttcctataccatgaactggactccgccacggctccgaggggaggcgacgtgggagtcgggtctcatctattaggnggtagaggtgtaattactaacaactacgcaagactcgactgggacgggccgtatccaccatcctcagagaacaacaccaaagtaactttactgtattctgactaaagtcggaacagacctgacgacgaccgaacgacgaccggtactcgttacttacgtttacgtggtcggtacggtacggtagggtttaccgggaatttacggttcggtacccggttaacgtccccgtaagtaccgttacccggg

SEQ ID NO: 106024 - DNA, 570 bp, Homo sapiens
  misc_feature: GYAE6OF02JWMSL.49.42.D09.1.454.CMB.1.raw
tcagagtcgagagacacgaccggtgctcgatttagacacatacgcaggggaaaggggagctctgagagaggagccttagccctggattccaaggcctatccacttggtgatcagcactgagcaccgaggattcaccatggaactggggctccgctggtttccttgtgctatttgaagtgtccttgtcaagtgcagctggtggagtctgggggaaagtggtcaagccgggggggtccctggagactctcctgtgcagcctctggattcaccttcgttcctatccatgaactggactccgccagggcctccgagggacggccgactgggagtggggtctcgatcgtataggtggtagaggtgtattacactaactacgcagactcgacgtgggacgggtccacgttcaccgatctacccagacgacaacaccaagtaactttacagtacttctagactaaatacggacagacctagacgagaccgacgacgacggctgtactattacgtgtcggacgtaggtaacggttcggtactagttaccggccgttacggtccctaggccttaaccgg

SEQ ID NO: 106025 - DNA, 537 bp, Homo sapiens
  misc_feature: GYAE6OF02GZNSA.49.42.D09.1.454.CMB.1.raw
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctatttagaaggtgtcccttgtcaagtgcagctggtggagtcgtgggggaaaggtggtcaaggccgggggggtcctgagactctcctgtgcagcctctggattcaccttccgttcctataccatgaactggatccgcaggctccgagggngcgactggagtgggtctcatctatgtggtagngtgattactacaactcgcagactcacgtggacgggccgtatccacatcctccagacacaacaccaaagtattactgtactctagacaaagtcggacagcctggagacgccgacgacacgctgtctattcgtggtcgacgtagtcgttacgggattacgttcgaccgttacgtcccagtcgtaccgg

SEQ ID NO: 106026 - DNA, 585 bp, Homo sapiens
  misc_feature: GYAE6OF02FP9RQ.49.42.D09.1.454.CMB.1.raw
  modified_base (369)..(369): a, c, t, g, unknown or other
  misc_feature (369)..(369): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
  modified_base (464)..(464): a, c, t, g, unknown or other
  misc_feature (464)..(464): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcaaggccgggggggtccctggagactctcctgtgcagcctctggacttcaccttccgttcctataccatgaactggactccgccaggcctccgaggggacggcgacgtgggagtgggtctcatctattagtggtagaggtnattactacaactacgacagactcacgtggacgggccattccacatccncgagacacaacaccaagtactttacngtatctagacaaatcggaacngacctgagacgaccgacgaccgacggcttaggtaccttattaccgtggtacggaccggtaagggtacggtttaccgggaatttacggttcggacccgttacgtcccgtagtacgtacccgg

SEQ ID NO: 106027 - DNA, 656 bp, Homo sapiens
  misc_feature: GYAE6OF02IG4SG.49.42.D09.1.454.CMB.1.raw
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
tcagagtcgagagacacgaccggtgctcgatttagacacatacgcaggggaaagggggagctctgagagaggagccttagccctggattccaaggcctatccacttggtgatcagcactgagcaccgaggattcaccatggaactggggctccgcgttgggttttccttgttgcttattttagaaggtgtcccttgtcaagtgcagctggtggagtcgtagggggaaaggtggtcgaagggccggggggtcctgagactctctgtgcagcctgtggattccacctttccgtcctataccatgaactggactccgcaggctccgagggnggcgacgtggagtgggtctnattctagttagnggtagtaggtagtacttaacacaactcgacagactcacgtggacgggcattcacatcncagacgaacaacacaagtaatttacagttactctagactaaagtacgggaactacggtacctaggaacgtaaccgggaccccgtaaccgggaaccgtaaccgggtaccttacgggttaacctttacggttttaccgtggttaacgggtaaccggtaagggttaaccgggtttacgggtaagtttacggttacccgggttaaccccggttaacgtaccccgtaggtaacgttcccccgg

SEQ ID NO: 106028 - DNA, 559 bp, Homo sapiens
  misc_feature: GYAE6OF02ITS7F.49.42.D09.1.454.CMB.1.raw
  modified_base (440)..(440): a, c, t, g, unknown or other
  misc_feature (440)..(440): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccggggggtccccgagactctcctgtgcagcctctggattcaccttccgttcctataccatgaactggatccgccaggctccgagggaggcgactggagtgggtctcatctattagtggtagaggtgattactacaactacgcagactcgactgggacgggccgattccgaccatcctccagacgaccaaacaccaaagtaactttacngttatcgtagacaaatggacagcctagagacgaccggacgaccacggctgtacttattactgtgcgaaggtcggttacggattagttcgccgttacgtcccaggtacctcggtaccccg

SEQ ID NO: 106029 - DNA, 587 bp, Homo sapiens
  misc_feature: GYAE6OF02HSOZS.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaagtggtcaaggccggggggtcctggagactctcctgtgcagcctctggattcacctttccgttcctataccatgaactggactccgccaggcctccgagggacgcgactgggagttgggtctcgatctattaggtggtaagaggttgaattactacaaacttacgacagaccttcaacgtgggacgggcccgattccaccatcctccagacgaacaacaacccaaagtaaactttactagtaatcgtagactaaatgggaacacggtacctaggagacgccgaacgaccgacgcctgtactacttacgtgtcgacgtaggacggttcggagttacgtcggaccgttacggtcccaggtacgtaccgg

SEQ ID NO: 106030 - DNA, 650 bp, Homo sapiens
  misc_feature: GYAE6OF02JPW4W.49.42.D09.1.454.CMB.1.raw
  modified_base (411)..(411): a, c, t, g, unknown or other
  misc_feature (411)..(411): n is a, c, g, or t
tcagagtcgagagacacgaccggtgctcgatttagacacatacgcagggaaaggggaaggcgtctgagagaggagccttagccctggattccaaggcctatccacttggtgatcagcactgagcaccgaggattcaccatggaactgggctccgctgggtttccttgttgctatttagaagtgtcctgtcaagtgcagctggtgagtctgggggaagtggtcaagccggggggtccctggacgactctcctgtgcagcctctggacttcaccttccggttcctattaccattgaacctgggacttccgccacggtcctccgagggaggccgacttgggagtgggtcctcgacttactagttaggtcggtaagtgggtagtacttactactaaacttcgcgtaagacccttnaaccggtgggtaacgggcccgtaaatttccgaccctagttccctacccgtaaggaccgaacaaacctacccgaaagaaacttttaacgtacgtaacgtttcgtacgaaccgtaaattcggggaacccaaaggtccttagggacgtacggtaccgaaccgtacgacggtcctaggtactacttagtcgtgacgtagcgttacgggattacggttgtaccgtacggtcccagtacgtccgg

SEQ ID NO: 106031 - DNA, 524 bp, Homo sapiens
  misc_feature: GYAE6OF02HJNUW.49.42.D09.1.454.CMB.1.raw
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (478)..(478): a, c, t, g, unknown or other
  misc_feature (478)..(478): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttcctgttgctattttagaaggtgtcccttgtcaagtgcagctggtggagtcgtgggggaaagtggtcaaggccggggggtcctggagactctcctgtgcagcctctggattcaccttccgttcctataccatgaactgatccgccaggctccgagggagcgactggagtgggtctcatctattagtggtagaggtgagttactacaactacgcagactacactggagggctatcgaccatctcaganacaacaccaagaattacngtatctagacaaatgacagcctgacgagaccgacgacacggctagtctattcngtcgcgtagtagttcggaatgttcgaccgtacgtcccagtctacgg

SEQ ID NO: 106032 - DNA, 522 bp, Homo sapiens
  misc_feature: GYAE6OF02GKUKI.49.42.D09.1.454.CMB.1.raw
  modified_base (320)..(320): a, c, t, g, unknown or other
  misc_feature (320)..(320): n is a, c, g, or t
  modified_base (405)..(405): a, c, t, g, unknown or other
  misc_feature (405)..(405): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccgggggggtccctgagactctcctgtgcagcctctggattcaccttacgttcctataccatgaactggatccgcaggctccgagggnggcgactggagtgggtctcatctattagtggtagaggtgattactacaactacgcagactcactgggacggccgattcaccatcnccagacgacaacaccaagactttactgtatctgactaaatggacagtccngagngccgagaccaggctagtctatcgtgtgcgagtgtcggatgtcgccgttacgccctagatccgg

SEQ ID NO: 106033 - DNA, 563 bp, Homo sapiens
  misc_feature: GYAE6OF02JIO55.49.42.D09.1.454.CMB.1.raw
  modified_base (557)..(557): a, c, t, g, unknown or other
  misc_feature (557)..(557): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaagtggtcaagccgggggggtccctgagactctcctgtgcagcctctggattcaccttccgttcctataccatgaactggatccgccaggctccgagggaggcgactggagtgggtctcgatctattagtcggtagaggtgtattactacaactacgcagactcacgtggaggcgtatcaccatctccagagacaacaccaagtaactttactagttatctagacaaagtcggaacagcctaggacgacgacccgacgaaccacggctaggtcttagttacctgtcggacgtaggtaggttccgggaattacgttcggcccgttaaggtcccgtagtntaccgg

SEQ ID NO: 106034 - DNA, 649 bp, Homo sapiens
  misc_feature: GYAE6OF02H5VIR.49.42.D09.1.454.CMB.1.raw
tcagagtcgagagacacgaccggtgctcgatttagacacatacgcagggaaagggggagctctgagagaggagccttagcctggattccaaggcctatccacttggtgatcagcactgagcaccgaggattcaccatggaactggggctccgcttgggttttccttgttgcttattttagaaggtgtcccttgtcaagtgcagctggtggagtcgtagggggaaaggtggtcaacgggccgggggggtcctgagactctcctgtgcagcctctggtattcctaccttccgttcctactacctatgaactggactccgcctaggcctccggagggacggcgacgtggaggttgggtctacatacttagttaggtggtaagtagggttagtaattaactaacaaactacgacacgactacacgtgggacggccgtacttacacctatcctacagaagaaccaaacaaccaaagtaactttacagttaactcgtacgaactaaagtacggaacacgaccttaggaacgacggacccgaaacgaccgtacggtactacgttactacgtttacgtacggtcgacggtaggtacgggtttacggaatttacgttacgggacccgtttacggtacccgtaggtaccgttaccccgg

SEQ ID NO: 106035 - DNA, 553 bp, Homo sapiens
  misc_feature: GYAE6OF02HRVG5.49.42.D09.1.454.CMB.1.raw
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccgggggggtccctgagactctcctgtgcagcctctggattcaccttccgttcctataccatgaactggactcccgccaggcctccgagggaggcgactgggagtgggtctnatctattagtggtagaggtnattactacaactacgcagactcacgtggagggccgtattccacctatcctaccagacgaacaaacaccaaagtaactttactagtatctagacaaagtcggacagcctaggacgacgaccgacgacgacgctgtactattactgcgacgagtaggttcggattagtcggaccgtacgtcccagactcgg

SEQ ID NO: 106036 - DNA, 700 bp, Homo sapiens
  misc_feature: GYAE6OF02JGT6U.49.42.D09.1.454.CMB.1.raw
tcagagtcgagagacacgaccggtgctcgatttagacacatacgcagggaaaggggaggctctgagagaggagccttagccctggattccaaggcctatccacttggtgatcagcactgagcaccgaggattcaccatggaactgggctccgctgggtttccttgttgctatttagaggtgtcccttgtcaagtgcagctggtggagtcgtgggggaaagtggcgaaggccggggggtcctgagctctctgtgcagcctcgtggtacttccaccttccgttcctactaccagtagtaacgtggtactcccgctaggcctccgagggacggcacgtggacgtcgggctcgattgtacgttaggtggtaacggtggtacgtattaccgtaataacgtacgacgtaagaccttcaacgttgggaacggccgtaattccgacctatccgtacccaaggacgtaaccaaacgaaccctaaaggttaaacctttacgttacgtaacgtccctaacggaagtaaaaccgtaggtaaccgtacggtaccccttaggaacgtaacggtaccccggaaccgaccggtaacggtacccgtgtttaaaccgtagtttaacccggttggttaaccgggaccttaaggggttaccgttccggggtaattaacgtttccgggaccgtttaacgggtacccaggtacgttccccgg

SEQ ID NO: 106037 - DNA, 599 bp, Homo sapiens
  misc_feature: GYAE6OF02HOSIV.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccggggggtccctgagactctcctgtgcagcctctggattcaccttccgttcctataccatgaactggatccgcaggctccgaggggaggcgactgggagttgggtctcgatcgtagttacgtggtagaggtgaattactacaacgtacgctagacctcgacttgggacgggcctattaccaccatcctaccagacgacaaaccacaaagtaactttacagttactcttagacaaagtggaactacgaccttaggaacgacgaccgaacgaccgacggctttagacttaagtttctaggtcgcggaaggtagggtttaccgggaatttcggtacggtcccggttacgtaccccgagtacgtacccgg

SEQ ID NO: 106038 - DNA, 606 bp, Homo sapiens
  misc_feature: GYAE6OF02HHK4E.49.42.D09.1.454.CMB.1.raw
  modified_base (157)..(157): a, c, t, g, unknown or other
  misc_feature (157)..(157): n is a, c, g, or t
  modified_base (269)..(269): a, c, t, g, unknown or other
  misc_feature (269)..(269): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagagtcgagagacacgaccggtgctcgatttagacacatacgcgagggaaaggggagctctgagagaggacgccttagcccctggattcccaaggcctatccacttggtgatcagcactgagcaccgaggattcaccatggaactggggctccgntgggtttccttgttgctattttagaaggtgtcccttgtcaagtgcagctggtggagtcgtgggggaaaggtggtcgaaggccgggggggtccctggagactctcctgtgcancctctggattcacccttccgttcctatacctatgaactggactccgccaggcctccgagggagcggacgtgggagtgggtctcgatctagttagtggtagtaggtgtaattactaacaactacgctaagacctacgactgggacgggtccgattccgaccatcctaccaagactacgaactaaccgaagtaaactttactagtactacgtagactaaagngaacngcctggagacgccgaacgcacggtcttacgatacgttaccgtggtacggcgtaggttcggttaccggtagttacgttcggacccggttacgaccccgaggtcttaccccggg

SEQ ID NO: 106039 - DNA, 621 bp, Homo sapiens
  misc_feature: GYAE6OF02IX47W.49.42.D09.1.454.CMB.1.raw
  modified_base (465)..(465): a, c, t, g, unknown or other
  misc_feature (465)..(465): n is a, c, g, or t
  modified_base (482)..(482): a, c, t, g, unknown or other
  misc_feature (482)..(482): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcaaggccgggggggtccctggagactctcctgtgcagcctctggattccaccttccgttcctataccatgaactggactccgccaggcctccgagggacggcgacgtgggaggtcgggtctcatcttagttaggtggtagagggtgtaattactaacaactacgcaagactcacgtgggacgggccgtattccacctatcctaccgagacgaacaaacaaccaaagtaactttacgngtatctgacaagtcganacgcctagacgacggacccgaacgaccgtacggacttcgtacttacgtttaccgtggtcggacggtaagggtacggtttacgggtaactttacgttcggtacccggttaaccgtccccggtaaggtaccgttaccccgg

SEQ ID NO: 106040 - DNA, 517 bp, Homo sapiens
  misc_feature: GYAE6OF02FG1LW.49.42.D09.1.454.CMB.1.raw
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (481)..(481): a, c, t, g, unknown or other
  misc_feature (481)..(481): n is a, c, g, or t
  modified_base (514)..(514): a, c, t, g, unknown or other
  misc_feature (514)..(514): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctggagactctcctgtgcagcctctggattcaccttccgtcctataccatgaactggatcccgccaggctccgagggagcgactggagtgggtctcatctattagtggtagaggtgattactacaactacgcagactcactggaggccgattcacatcnccagacgacaacaccaagaatttacngtatctnacaaatggaacngcctgagacgccgacgacacggctagtctatacngtgcgagtgttcggatattcgccgtagcccagntcg

SEQ ID NO: 106041 - DNA, 563 bp, Homo sapiens
  misc_feature: GYAE6OF02G56IZ.49.42.D09.1.454.CMB.1.raw
  modified_base (361)..(361): a, c, t, g, unknown or other
  misc_feature (361)..(361): n is a, c, g, or t
  modified_base (452)..(452): a, c, t, g, unknown or other
  misc_feature (452)..(452): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcgaaggccgggggggtccctggagactctcctgtgcagcctctggattcaccttccgttcctataccatgaactggactccgcaggctccgagggacggcgacgtggagtgggtctcatctattagtggtagngtgattactacaactacgcagactcacgtggacgggccattccacatcctcaagagacaacaacaagtaatttacagtatctgactaaagnggacagcctagacgacgaccgacgaccgacggctgtaccgttattacgtgtggacgtaggtaggttcgggtattacgttcggaccgttagtaccccgtagacgttacccgg

SEQ ID NO: 106042 - DNA, 631 bp, Homo sapiens
  misc_feature: GYAE6OF02HB0O2.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgatgctatttagaaggtgtcccttgtcaagtgcagctggtggagtcgtgggggaaaggtggtcgaaggccggggggtcctgagactctcctgtgcagcctctggacttcctaccttccgttcctataccatgaactggactccgccaggcctccgagggacggcgacgtgggaggtgggtcctcgactcgtacgttaggtggtaggtaggtgtatttaccgtacaacgtacgacagactcgacgtgggacgggccgtattccgacctactcctaccgtagaacgaaccaaacaaccaaagtaactttacgtagttactcgtagtacaaagtcggaactacggtcctaggaacggacggcccgaacgaaccgaccggtactcgttacttacgttacgtggtcgacggtacggtaggtttccgggtaattcgtttacgggacccgttaacggttccccaaggtacccg

SEQ ID NO: 106043 - DNA, 572 bp, Homo sapiens
  misc_feature: GYAE6OF02GNTR9.49.42.D09.1.454.CMB.1.raw
  modified_base (507)..(507): a, c, t, g, unknown or other
  misc_feature (507)..(507): n is a, c, g, or t
  modified_base (558)..(558): a, c, t, g, unknown or other
  misc_feature (558)..(558): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcaaggccgggggggtcctgagactctcctgtgcagcctctggattcaccttccgttcctataccatgaactggactcccgccaggcctccgaggggacggcgacgtgggagtgggtctcgattctagttagtgggtaagtagggtgtaattacctaactaactacgcagactcgacgtggacgggccgtattccgaacctatcctccgagaacgacaaacaccaagtaactttacagtatctgacaaagtcggacacgccgtagacgacgccgacgacncggctgtctatacgtgtgacgaggtagttcgggattacgtcgaccgttacnccgtagtctaccgg

SEQ ID NO: 106044 - DNA, 587 bp, Homo sapiens
  misc_feature: GYAE6OF02HJBWQ.49.42.D09.1.454.CMB.1.raw
  modified_base (468)..(468): a, c, t, g, unknown or other
  misc_feature (468)..(468): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcgaaggccgggggggtccctggagactctcctgtgcagcctcgtggattcaccttccgttcctataccatgaactggatcccgccaggctccgaggggaggcgactgggagtgggtctcatctagttgtggtagaggtgattactacactacgcagactcacgtggacgggcctattccacctatcctccagtacgaccaaacaccaaagtaacttactgtactcttagacaaagtcganacgcctagacgacgccggaacgaccgacggcttcgtactacgtttacgttggtcgtacggaggtacggtttacgggaattcgttcggacccggttaacggtccctaggtcgttacccgg

SEQ ID NO: 106045 - DNA, 589 bp, Homo sapiens
  misc_feature: GYAE6OF02GTAH0.49.42.D09.1.454.CMB.1.raw
  modified_base (359)..(359): a, c, t, g, unknown or other
  misc_feature (359)..(359): n is a, c, g, or t
tcagagtcgagagacacgaccggtgctcgatttagacacatacgcagggaaagggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccggggggtccctgagactctcctgtgcagcctctggattcaccttccgttcctataccatgaactggatccgccaggctccagggaggcgactggagtgggtctcatctattagtcggtagaggtnattactacaactacgcagactcactggacggccgattcaccatctccagacgacaacaccaaagtaactttacgtgtatctagactaaagtggaacagcctagacgacgcccgaagaccaccgggtctacggttaccttagtttaaccgtggtacggaccggtagtacgggttttaccgggaattacggtttcggtacccggttaacggtccccgaaggtacttcccggg

SEQ ID NO: 106046 - DNA, 570 bp, Homo sapiens
  misc_feature: GYAE6OF02HJFVX.49.42.D09.1.454.CMB.1.raw
  modified_base (364)..(364): a, c, t, g, unknown or other
  misc_feature (364)..(364): n is a, c, g, or t
  modified_base (472)..(472): a, c, t, g, unknown or other
  misc_feature (472)..(472): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcaaggccggggggtccctggagactctcctgtgcagcctctggattcaccttccgttcctataccatgaactggactccgccaggcctccgagggaggcgacgtggagtgggtctcatctataggtggtagaggtnattactacaactacgcagactcgacgtggacgggccgtattccaccatctaccagacgaacaaacaaccaaagtaactttacgtgtactctagactaaagtcggaacngccgtagacgagccgacgacgacggtctagtctactacgtcgtcggacgtaggtaggttcggatttcgtacggccgttacgtacccaggtatacccgg

SEQ ID NO: 106047 - DNA, 607 bp, Homo sapiens
  misc_feature: GYAE6OF02GSRML.49.42.D09.1.454.CMB.1.raw
  modified_base (491)..(491): a, c, t, g, unknown or other
  misc_feature (491)..(491): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggtttccttgttgctattttagaggtgtcccttgtcaagtgcagctggtggagtcgtgggggaaagtggtcaggccggggggtcctggagactctccgtgtgcagcctgtggacttccaccttcgttcctataccatgaactggactccgccaggtctccgagggacgcgacgtgggacgtgggtctcatcgtagttagtggtagaggtgtaattactactaacgtacgacgaacgactcacgtgggacgggtccgtattccacctattccgtaccaaggtcaaaccaaacgtaccaaagtacttttacagtacttcgagtactaaagtggaacgngtaccgtgaccgacgccgaacgaccgcgtctagtacttagttccgtggtcggtacggtaacggtacggttacgggaattcggttccggtaccgttaggtccctagccgttacccgg

SEQ ID NO: 106048 - DNA, 578 bp, Homo sapiens
  misc_feature: GYAE6OF02HYCCA.49.42.D09.1.454.CMB.1.raw
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (488)..(488): a, c, t, g, unknown or other
  misc_feature (488)..(488): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggactggggctccgctgggtttccttgttgctatttagaaggtgtcccttgtcaagtgcagctggtggagtcgtgggggaaaggtggtcaaggccggggggtcctgagactctcctgtgcagcctgtggattcaccttccgttctataccatgaactggactccgccagctccgaggggaggcgacgtggagtggtctntatctattagnggtagagtnattacacaanacgcagactcacgtggacggccattacaccatcctccagagaaccaacaaccaaagtaactttactagtactctagacaaagtcggaacacgactagagacggaccgaacgaacgaccggtntacgttactacttacgtggtcggacggtagtacggtttacgggaattacgttaccggacccggttaacggtcccctaggtacttacccgg

SEQ ID NO: 106049 - DNA, 613 bp, Homo sapiens
  misc_feature: GYAE6OF02I0OUP.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaggtgtcccttgtcaagtgcagctggtggagtcgtgggggaaaggtggtcaaggccggggggtcctggagactctcctgtgcacgcctctggtacttccaccttccgttcctataccatgaactggactccgcaggctccgagggacggcgacgtggacgtgggtctcattctagttaggtggtagagggttagtacttactaacaacgtacgacagtactcgacgtcgggacgggtcccgtagttccaacctactcctaccgaagacgaaccaaacaaccaaagtaactttacgtacgttactcgtagaactaaagtggaacacgacctaggacgacgaccgacgaccgacgtcgtagtacttagttacgtgtcggaccgtaggtacggttacggattaggttccggaccgttacgtacccgtagtcggtaccg

SEQ ID NO: 106050 - DNA, 633 bp, Homo sapiens
  misc_feature: GYAE6OF02J00WA.49.42.D09.1.454.CMB.1.raw
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
  modified_base (538)..(538): a, c, t, g, unknown or other
  misc_feature (538)..(538): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggtttcctgttgctatttagaggtgtccttgtcaagtgcagctggtggagtcgtagggggaaaggtggtacgaacggccgggggggtccctggacggtactcctccgtgtgcagtcctgtggacttcacctttccgttcctactaccatgaactggactcccgacaggcctccgagggacgcgacgtgggacgtgggtcctactacttctagttacggtggaacggtggtataacttactaacactacgagacgtactctacggtggacggtacctactacacctatccacggacganaaccaaacaccgtaaagttaccttaagttgtaacttcganaactaaaggtcgaacgtctactggaacgaccgaccgtacgaccgngttacctgtaacgttacgttagtcgtacggtacgtaaggtcgggtaacgttataccggttcggtaaccgttcgaccgttacgaccgttaaccccg

SEQ ID NO: 106051 - DNA, 546 bp, Homo sapiens
  misc_feature: GYAE6OF02GCR5L.49.42.D09.1.454.CMB.1.raw
  modified_base (361)..(361): a, c, t, g, unknown or other
  misc_feature (361)..(361): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggtttccttgttgctattttagaaggtgtcccttgtcaagtgcagctggtggagtctgggggaaaggtggtcaaggccggggggtccctgagactctcctgtgcagcctctggattcaccttccgttcctataccatgaactggatcccgcaggctccgagggacggcgacgtggagtgggtctcatctattaggtggtagaggtnattacacaactacgcagactcacgtggacgggcctattcaccatccnccaganaacaaccaaccaagtaactttactagtatctagacaaagtggaacagcctagagacgccgacgacacggctgtactattcgtgtgacgtagtcggttacggtattagttcggaccgttacgcccagatccgg

SEQ ID NO: 106052 - DNA, 890 bp, Homo sapiens
  misc_feature: GYAE6OF02HHY3V.49.42.D09.1.454.CMB.1.raw
  modified_base (261)..(261): a, c, t, g, unknown or other
  misc_feature (261)..(261): n is a, c, g, or t
  modified_base (809)..(809): a, c, t, g, unknown or other
  misc_feature (809)..(809): n is a, c, g, or t
tcagagtcgagagacacgaccggtgctcgatttagacacatacgcagggaaaggggagcgtctgagagaggagccttagccctggattccaaggcctatccacttggtgatcagcactgagcaccgaggattcaccataggactaggggctccgctgggttttccttgttgctatttagagtgtcctgtcagtgcagctggtgagtcgtgggggaaaggtggcaaggccgggggtcctggagactcgtctgtgtcagtccncgtggacttccgtaccttccgttcctaactaccacgttacgaacgtcggtaacgtcccgtacccggtaacggtccgttacccccggtaagggacgggttacccggaacccgttggggtaaacggggtttccgggggttccttacccgggtaaaccttcgtttaaacggttaaccgggttacgggttaaggtaaccggggtagttaaccggtttaaaacctaaccgggttaaaccctaaaacccgggttcgaaaccggttaacttacccgtaaccgggtttcgggggaacggggtaacccggttaaactttccggaaaccccttacgttaccgttacccgaaacggggtaaaccgtaaaccgaaacccgttaaaacccgtaaaaagtaaaacggttttttaactaaaccgggtttaaaccttacggtacgttaaaaccggaaacgtacggggttaaccgaaacctccggtttacggacggttaaacccgcgggaaccggtaacccgaacgggtaacccgtatttaccggtaacgttaaaggtttccggngggtaaccgaagggtttccgtaaccggggtatttaacctcgggtaaccgtaccggggtaacctaccggtttacgaccccgg

SEQ ID NO: 106053 - DNA, 755 bp, Homo sapiens
  misc_feature: GYAE6OF02JQHZS.49.42.D09.1.454.CMB.1.raw
  modified_base (435)..(435): a, c, t, g, unknown or other
  misc_feature (435)..(435): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggtttccttgttgctattttagaggtgtcccttgtcagtgcagcgtggtggagtcgtgggggaaaggtggtcgaagggtcccgggggggtccctggacgacgtccgtccgtgtggccaggtcctctggacttccgacccgtttccgttcctacttacccatcgtaacgtggactcccggcacggtctaccgaggggtacggcgactcgggaggtcgggtctcgattccgtagttaggttacgggtaggtaggttgtagttaacctaacgtaactaccggntaacgtaccgttcgaacgttacggggacgggacccgtatttacccgaactacgttccctaaccgacgtaacggaaccaaccgtaacaaacgtaactttaacgacgttactacctacggtactaaaagtccgggtaaacgtcggtaacctagggaaccgtaacggacccgtaacgaacccggtaccgggtacttacggtaaccttaggttaacccttggggtaacgtaacggttacgggtaacgggtttacccgggtaagtttaccgggtttaccggtaccggttaccgtttccccgggaacgtttcggttaacccccggg

SEQ ID NO: 106054 - DNA, 784 bp, Homo sapiens
  misc_feature: GYAE6OF02ITP4D.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtagggggaaaggtggtcaaggccgggggggtccctgacgactctcctgtgcacgcctctggattcacctttccgttcctactaccatcgaactggactccgaccgaggcctccgaggggacggcgacgtgggacggtcggggtctacgactcgttaagttacggtggttaaggtagggttagtaatttaccgtaacctaaacgttaccggactaacgtaaccgtccgtaacggtacgggaacggggacccgtaacgtttacccgaaacctacttacccgtaacccggtaaggaaacggaaccaaaccgaaaccaaaacggtaaaccttttaacggttacgttaaacttaccgttacgaaccgttaaaacgtcgggtaacacgggtacccttagggaaacgaccgggaacccggtaaacggaaccgaccgggtaccttcgggttacctttacgtttaccgttagggtaccggacgggttaacgggttaagggttttaaccgggggtaacttttaagggttaccggttaccccgggttaagttacccccgggtattaacccgggttacccggg

SEQ ID NO: 106055 - DNA, 563 bp, Homo sapiens
  misc_feature: GYAE6OF02HZ6YT.49.42.D09.1.454.CMB.1.raw
  modified_base (471)..(471): a, c, t, g, unknown or other
  misc_feature (471)..(471): n is a, c, g, or t
tcagagtcgagagacacgaccggtgctcgatttagacacatacgcagggaaagggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctgggtggagtcgtggggggaaaaggtgggtcaaggccgggggggtccctggagactctcctgtgcagcctctggattcaccttccgttcctataccatgaactggactccgccaggctccgagggaggcactggagtgggtctcatctattagtggtagaggtgattaacacaactacgacagactcacgtggagggccgtattccaccattctacccaagacgaacaaaccaccaaagtaatttaacctgttaactctagactaaanggacagacctagagcgaccgacgacacggctgtacttattacgtgtcgacgtagaggttcggatgttcgtaccgtaggtccctagatcccgg

SEQ ID NO: 106056 - DNA, 730 bp, Homo sapiens
  misc_feature: GYAE6OF02I1GNG.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggatcaccatggactgggctccgctgggtttccttgttgcttatttagaggtgtccttgtcaagtgcagctgggtgagtcgtagggggaaggtggtcgagggccgggggtcctggagtactctccgtggtgcgagcctcgtggacttcctacccttccgttcctaactacctatacgtaacgtacgggtactccccgacgtacggcctaccggaaggggacggcgtaaccggtagggcggttgggtaccgtactacttacgttacgttagggtaggtaaggtaggggttataacgttaacttaacgaaactacggctacgtaacttcgacggtacgggacggggtacctaattccgaacctacttcccgtaccaaaggacgtaaaccaaacgttaaacccgaaagttaaccgtttaactgttaacgtcgttaacgaaacgtaaggtaaccggaactaccggtaccgtaggaaacgacccggtccggaaacgaccggccggtatacggttctaacgttacggagttccggaacgttaggtaacggttacgggtaattacggttccgggtaaccggttaccggtaccgtaggtcgtaacccccggg

SEQ ID NO: 106057 - DNA, 620 bp, Homo sapiens
  misc_feature: GYAE6OF02FJ64B.49.42.D09.1.454.CMB.1.raw
  modified_base (482)..(482): a, c, t, g, unknown or other
  misc_feature (482)..(482): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggactggggctccgctgggttttccttgttgctattttagaaggtgtcccttgtcaagtgcagctggtggagtcgtgggggaaaggtggtcaaggccgggggggtccctggagactctcctggtcgcacgcctctggattcaccctttccgttcctataccatagaactggactcccgccgaggcctccggagggacggccgacgtgggagtgggtctcgtagttccttagttacgggtggttaggagggtgtaactttacgtaactaacgttacgcaagtactacacgtgggacgggcccgtatccaccatccacagacgaacaacaccaaagtaactttacgntactctagtacaaagtcggacgacgtccgtagacgacggccgaacgaccacggcttgttactacttacgtaggtggacggacgttacggttacgggtattacgttcggtacccggttacgtcccgtaggtccgtccgg

SEQ ID NO: 106058 - DNA, 698 bp, Homo sapiens
  misc_feature: GYAE6OF02JZL4U.49.42.D09.1.454.CMB.1.raw
  modified_base (448)..(448): a, c, t, g, unknown or other
  misc_feature (448)..(448): n is a, c, g, or t
tcagagtcgagagacacgaccggtgctcgatttagacacatacgcagggaaaggggagctctgagagaggagccttagccctggattccaaggcctatccacttggtgatccagcactgagcaccgaggattcaccatggaactggggctccgcgttgggtttccttgttgctatttacgaggtgtcccttgtcaagtgcgagcgtggtggagtcgtagggggaaaggtgggtcgaacggccgggggggtccctggaacgcctactccgtgtacgcacgccgttcgtaggtacttcctacccgtttccgttacctaactaccctagtcgtaacgtcggacctccgcccgacggtcctaccggagggtacggcgacgtgggaggtcggtctacgtacgtcttagtacggtaggtagtggtacgtacttactactaactacgtcagtacnctacgtaggacggacgtacttaccacctactcgtaccgagaccgaaaccaaaccgaacgtaacgttaacttacgtagttaactcgtacacgtaaagtcggaacacgtactaggaacgtaccgggaccgaccgtaaccacggttcctacgttcttacgttcggttaaggccggtaacgacgggttacgggttaccgggtaattacgggttaccggacccggttacccacggttaacgtcccgttaccccgg

SEQ ID NO: 106059 - DNA, 795 bp, Homo sapiens
  misc_feature: GYAE6OF02FSRV4.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcacatggactggggctccgcgttggttttccttgttgcttattttagaaggtgttcccttgtcaagtgcagtcgtgggtggagttcgtagggggaaaggtggtacgaagggcccgggggggtccctggagtaccttcctccgtggtcgcgacgccttgtaggtacttccaccctttccgtttaccttaactacctaagtacgtaacgtggtactcccggccgaacggcctaccggaggggacggccggacgtgggtacgtgggtctacgattcgttaagtttacggtgggtaggtagggttagtacttaaccgtaaccgtaaacgtacgacaacgtaacctcgtaacggtcgggaacgggcccgttattcccgaacgtactaccttaccgaaggtaccaaaccgtaaacaaaccccgtaaagtaaaactttttacgtcgttaacgttactacggaactaaacgttcgggaaaccagggtacccttagggaacgtaccggaacccgaacgggaacccgtacgggacctttcggttacctttaacggttaccgtacggttaaccgggtaccgggtaacgggttaaggggttttacccgggtaaagtttacggttcccgggttaacccggtttacccgggtaccctaacgggtaacgtttcccccgg

SEQ ID NO: 106060 - DNA, 633 bp, Homo sapiens
  misc_feature: GYAE6OF02G8QEU.49.42.D09.1.454.CMB.1.raw
  modified_base (264)..(264): a, c, t, g, unknown or other
  misc_feature (264)..(264): n is a, c, g, or t
  modified_base (366)..(366): a, c, t, g, unknown or other
  misc_feature (366)..(366): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactgggctccgctgggttttccttgttgctattttagaaggtgtcccttgtcaagtgcagctggtggagtctgggggaagtggtcgaaggccggggggtccctgagactctcctgtgcagcctntggattcaccttccgttcctataccatgaactggactccgccaggcctccgagggacggcgacgtgggagtgggctcatctacgttagtcggtagtgggtanacttactacaactacgcagactcactgggacgccgtagttcaaccctatcctcgaacgtacgaaccaaaccgacctaaagtaacttttaacctaggttaattccgtagactaaaagtcgggaaacacggccgttagaacgaacggacccgacggtaaccgtacggaccttacgtactacgtttacgtaggttcgacggtaacgtagggtttacggggaatttacgttccggtaccggttaccggtacccctaggtacttaccccggg

SEQ ID NO: 106061 - DNA, 721 bp, Homo sapiens
  misc_feature: GYAE6OF02HZYVC.49.42.D09.1.454.CMB.1.raw
  modified_base (648)..(648): a, c, t, g, unknown or other
  misc_feature (648)..(648): n is a, c, g, or t
  modified_base (706)..(706): a, c, t, g, unknown or other
  misc_feature (706)..(706): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgtgcttattttagaaggtgtcccttgtcaagtgcagctggtggagtcgtagggggaaagtggtacgaacgggccggggggtccctggagactctcctggtgcagcctctggattccaccttccgttctactaccatcgtaacgtggactccgccacggtcctacggagggtacggcgtacgtgggtaggttcgggtctctaattccgttaagttacggtggtacggtagggtagtaacttaacgtaacctaacgtaaccgatacggtaaccttcgtaacgtcggggtaaccggggtacccgtacgttacccgaacccgtattaccccgtacggtaaacgaacggtaaccaacctaaacccgtaaagttaacctttaagttacgttaagtccttacgaaacgtaaagtacggaaccggtactaccggtagaaccggtcggaccgtaaaccgaacgtaccggtcgtacggttacttacgttacgnggtacggtacggtacggtaccggtttaggtaacttggttaccgcccggttactaccgngtaccggttccccgg

SEQ ID NO: 106062 - DNA, 605 bp, Homo sapiens
  misc_feature: GYAE6OF02G6QE1.49.42.D09.1.454.CMB.1.raw
  modified_base (426)..(426): a, c, t, g, unknown or other
  misc_feature (426)..(426): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaaggccggggggtccctggagactctcctgtgcagccctctggattcaccctttccgttcctataccatgaactgactccgcaggctaccgagggcgcgacgtggagtgggtctcatcgtaattagtggtaagtaggtgtaattactaacaactacgcagtacctacgacgtagggaacgggccattccacctactcnccaggaacgaaccaaacccaccaaagtaacttttacgagttactcgtacgacaaagttcgacgtagtccgtagacgacgaccgaacgacgacggtcgttcggttactagttacgtgtcggacgtaggtacgttacgggtattacggttcgtaccgttcggtccctaggtacttacccgg

SEQ ID NO: 106063 - DNA, 789 bp, Homo sapiens
  misc_feature: GYAE6OF02HL4C5.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggactggggctccgcttgggtttccttgttgcttattttagaaggtgtcccttgtacaagtgcagctgggtggagtcgtagggggtaaaggtggtacgaacgggtcccgggggggtccctggacgtaccgtctccgtgtcgcgtagccttgtcggtactttaccgacccgtttcccggttacctaactacccaagtacgtaacgtgggaactcccggaccgacggtcctaccggaaggggacggccgacgtcgggtaggtcgggtctcgtagtacgttagttacggtggtaaggaggtgtaattaacgtacgtaaacgtacgctaacgtacctacacggtagggacgggtacctacgtaccgacctacgttacctaccgaaggaaccgaaacctaaaccgaaaccgttaaagtaaacttttaccgtagttaactacgtacgtaaacgtaaacgtacgggaacctacggttaccgaggacgtaaccggtaacccgaacggaacccgtacgggtaccttacggttacccttaacgttttaacggtcggggtaacggcccggttaaaggggttaccgggtttaacggggttaacttagggtttacccggaccgggtttacccgggttaacccgacggttacggttaacccccggg

SEQ ID NO: 106064 - DNA, 644 bp, Homo sapiens
  misc_feature: GYAE6OF02GNUUN.49.42.D09.1.454.CMB.1.raw
  modified_base (371)..(371): a, c, t, g, unknown or other
  misc_feature (371)..(371): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgcttattttagaaggtgtcccttgtcaagtgcagctggtggagtcgtgggggaaaggtggtacaaggccgggggggtccctggacgacgtctcctgtcgcaggcctgtggattcaccttccgtcctataccatgaactggactccgccaggcctccgagggtagcgacgtggaggtgggtctctatctagtgtggtagaggtnaattacactaactacgcagtactcacgtgggacgggccattaccacctatcctccgagaccgaaccaaacgaaccgtaaagtaaacttttacgagtacttaccgtaggaacctaaatgggtaacctaggaccttagggaacgacggtaccgaaaccgacgaacgggtcttaggtaccttagttactagggtcgtaacggtacggtaacgggtttacggtaagttacgttcgggtacccggttaacggtaccccgtaagtaccggttaccccgg

SEQ ID NO: 106065 - DNA, 762 bp, Homo sapiens
  misc_feature: GYAE6OF02HQ2XO.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgtgcttatttagaaggtgtcccttgtcaagtgcagctggtggagtcgtagggggaaaggtggtacgaaggccgggggggtccctggacgactctcctgtgcacgcctcgtggacttccgaccttccgttcctactaccatcggaactcggactcccgccgaggtcctacggaggggacggccgtacgtgggtacggtgggttctacgtacgttacgttaggttagggttagggtaaggtagggtagtaacgttaactaaccgtaacgtaccgtacgaagtacctacgtacggtggggtacgggtaccgtactttaccaacccgtacgtccccgtaacctaaggaaacgtaaacccaaaaaccgaacccgttaaaagttaaacgtttttaacctacggtttaacttccggttacgaaacgtaaagtaccgggactaacgtacccgtaaggacgaaccggaccgtaaacccgggacgtaacccggtccgttaagttccgttaacgtttacgttacgggtaacgaaccgggttaggtaaccgggttaccggagttttaacggtcggtaacccggttacggtaccagggttacctacccgg

SEQ ID NO: 106066 - DNA, 672 bp, Homo sapiens
  misc_feature: GYAE6OF02GE3LD.49.42.D09.1.454.CMB.1.raw
tcagagtcgagagacacgaccggtgctcgatttagacacatacgcagggaaagggggagctctgagagaggagccttagcccctggattccaaggcctatccacttggtgatcagcactgagcaccgaggatcaccatggaactgggctcgctggtttctgtgctatttagagtgtccttgtcaagtgcagcgtggtggagtctggaaggggtaaaggtggtacgaagggtcccgggggggtcccctaggacggacttccgtccgtggttcgcgacgtcctcgtggtacgttcctacccgtttcccgttacctataccctatacgtaacgtcggtacctcccggccaggcctaccgagggacggacgacgtggacgtcgggtctcgattcgtattaggtcggtaggaggttagaacttacgtaactaactacgacacgtactcacgtggaacgggccgtataccgtaacagtaccaccgaagtacgaaccaacgtaaccaaagttaacttaactacgtacttacgactacgtaatacggtacgacgtcgtagacgaccgacggtaaccgacggtaccgtcgtagttaccgttaagttaccgtaggtccgaacggtaggttacgggttaccggtaattaccggtacggtacccgttacgtcccggtaagtccg

SEQ ID NO: 106067 - DNA, 699 bp, Homo sapiens
  misc_feature: GYAE6OF02IX3XJ.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtccttgtcaagtgcagctggtggagtcgtggggaaaggtggtcgaagccgggggggtccctgacgacgtctcctgtgcagcctctggacttcaccttccgttcctataccatgaactggactccgcaggctccgagggtcggcgacgtcggaggtgggtctcgatctatgtggtagtagtgtattacctataaactacggtcaacgtactacaccggtagggacgggtaccgtagtttacccgacctaagttcccctaaccgtaggaacgaactaaaaccaacccgtaaaaggtaaacgtttttaccacggttaattccgtaagaccgttaaaagtcgggaccgttaacgtcccgtagaaacggtaccggtcccgggaccgaaaccgtaccggtacttgggttacctacgttttacggtacgggtccgttaacgggaggttaccggtttacggggaattttaacggttcgggtaaccccggtttaccgacccggttaacgggtattaaccccggg

SEQ ID NO: 106068 - DNA, 750 bp, Homo sapiens
  misc_feature: GYAE6OF02IMMEY.49.42.D09.1.454.CMB.1.raw
  modified_base (189)..(189): a, c, t, g, unknown or other
  misc_feature (189)..(189): n is a, c, g, or t
  modified_base (599)..(599): a, c, t, g, unknown or other
  misc_feature (599)..(599): n is a, c, g, or t
tcagagtcgagagacacgaccggtgctcgatttagacacatacgcagggaaaggggagctctgagagaggagccttagccctggattccaaggcctatccacttggtgatcagcactgagccaccgaggattcaccatggaacgtggggcctccgcttcgggttttccttgttgtcttatttagaggtntcccttgtcaagtgcagctgggtggagtcggtaggggggaaaggtgggtacgacgggcccgggggggtcctaggacgacctctccgtgtgcacgcctgtacggtacttaccgtacccgttccgttacctaactacctatacggaaaccgttggactcccgaccgtacggtccgtaccggaggggaacgccggtacggtacgggtacgggttacgggtccttactaacgttaccgttaaggtttaagggtagggtaagggttagggtaaacttaacgtttaaacctaaacgaaccgttaaacggactaaacgacgtttaccggacggtaaggggtaccggggtaccgtacgttaccaaccgtacgtacctaccggacgtaacggaacctaaaccgaactaaagtaacttancgttaactcgtataacaagtacgacacgactaggacgacgacgacgtaaccgacgtactcgtacttatacgtcgtacggtacgtagggttacgtacggttacgttacggttaccggaccgtttaaccgaccggtacgaccgttaacccggg

SEQ ID NO: 106069 - DNA, 602 bp, Homo sapiens
  misc_feature: GYAE6OF02GB0JQ.49.42.D09.1.454.CMB.1.raw
  modified_base (500)..(500): a, c, t, g, unknown or other
  misc_feature (500)..(500): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtagggggaaaggtggtcgaaggcccgggggggtccctggacgactctcctgtgcacgccttctggacttccaccctttccgttcctactacctagtcgaactggtactcccgaccaggcctccgagggaggcgacgtgggagtgggtctcattctagttagtggtagtaggtgtacttactaactaactacgcaagactacacgtgggacgggccgtacttacaaccatcctaccgagacaaccaaacaccaaagtactttactgtactctagactaaagtcggaanacgcgtaggagacgccgacgacgacggtctgtaccttagttactgtcggacgaggtacggtacggtattacgttcggaccgtagtacccgagtactacccgg

SEQ ID NO: 106070 - DNA, 719 bp, Homo sapiens
  misc_feature: GYAE6OF02FOXBG.49.42.D09.1.454.CMB.1.raw
  modified_base (380)..(380): a, c, t, g, unknown or other
  misc_feature (380)..(380): n is a, c, g, or t
tcagagtcgagagacacgaccggtgctcgatttagacacatacgcgagggaaaggggagctctgagagaggagccttagccctggattccaaggcctatccacttggtgatcagcactgagcaccgaggattcaccatggaactggggctccgctgggttttccttgttgctatttagagtgtcccttgtcaagtgcagctggtggagtcgtagggggaaaggtggtacgaaggccggggggtccctggacgactctcctgtcgcagcctctggattccacctttccgttcctactaccatacgaactggactcccgccaggcctaccgagggacggcgaccgtggagtgggtctcattctattggtaggtagtagggtntacgtttaactacgtaacgttacgacgaacgacctacacgtaggggtaccgggtcccgtatttacccgaccctacgttccctaccgaagaaccgtaaccaaaaccgaactaaacggttaattttaaccgtagttacttcgtaacaaacgtaaacgttcggaaaccctagaccgttacggaacgtaccgaacccgggaaccgaaccggtaccggtccttacgggttacttaaccgtttacggttacggttacggaccggttaaggttacggttaccgggttaagttaccgtttcggtaacccggtttaccggtacccgtacggtaccgtttaaccccggg

SEQ ID NO: 106071 - DNA, 591 bp, Homo sapiens
  misc_feature: GYAE6OF02HARB9.49.42.D09.1.454.CMB.1.raw
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
  modified_base (447)..(447): a, c, t, g, unknown or other
  misc_feature (447)..(447): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttccttgttgctatttagaaggtgtcccttgtcaagtgcagctggtggagtcgtgggggaaaggtggtcaaggccgggggggtccctggagactctcctgtgctagcctctggattcaccttccgttcctataccatcgtaactgggactccgccaggctaccgagggacggcgacgtgggagtgggtctnatctattagtggtagtagtnattctaacgtaactacgcagactnactggacggcgattcaccatctccgagacgaacaacaccaagtaacttaacgngtaactctgacaaatggactaggcctagacgtacggacgaaccggaacgccggacttggtacttagtacttgggtacgacggtaggtaacggtttcgggaatttacgtacggtccggtaaccgtacccgtagtaacgttcccgg

SEQ ID NO: 106072 - DNA, 743 bp, Homo sapiens
  misc_feature: GYAE6OF02H3UUB.49.42.D09.1.454.CMB.1.raw
tcagagtcgagagacacgaccggtgctcgatttagacacatacgcagggaaaggggagctctgagagaggagccttagcctggattccaaggcctatcccacttggtgatcagcactgagcaccgaggattcaccatggaactggggctccgcgttgggtttttccttgttgtcttattttagaaggttcgtcccttgtacaagtgcagctggtggagtcgtaggggggaaagtggtacgaacgggcccgggggggtcctggacgtacctctccgtgtgcagcctcgtggtacttccgacctttccgttacctactaccatacgaacgttggaccttcccgccgtaggcctaccgagggacgtcgacgtgggagtagggtctataccgtatagttaggtggtacgtagggtataacgtttaaccgtaaccgtaacctacggacgtaacgtacctaccgtaaacggttggggaaccggcctacgtaccctaaccgcttacctaccgaagtacgaaaccctaaaccgaaccgtaaattaacgtttaacgttacttacttacgtaacgtaagtaaaacgtcggaaacctacgaccgttaggaaccgaaccggaaccccggactaaaccggcggtacctttaggacctttacggttaccgttcgggtaagtaacccggtgggttaaaccggttcggaacgtttcgtaccggtacccggttacgtacccgtggtacctaacccccggg

SEQ ID NO: 106073 - DNA, 791 bp, Homo sapiens
  misc_feature: GYAE6OF02JXB6A.49.42.D09.1.454.CMB.1.raw
  modified_base (192)..(192): a, c, t, g, unknown or other
  misc_feature (192)..(192): n is a, c, g, or t
  modified_base (653)..(653): a, c, t, g, unknown or other
  misc_feature (653)..(653): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctggtttccttgttgctatttagagtgtccttgtcaagtncagctggtggagtcggtagggggaaaggtggtcgaagggccgggggggtcctgacgactctccgtgtgcgacgcctcgtggtacttcctaccgttccgtttaccgtacttaccgagttacgaacgtcggtacttcccggtaccgtaacgggtccttaccggaacggggacgggtacccggtaacggtcggggtacgggttcgggttacccgtacgtaacgttaccgtttaaggttacgggttagggtaacggttacgggttacgtaactttaaccgtaaaccgtaaaccgttaaccggttacgaaacgtacccgttacgaaaccggttagggggtaaccgggtcccgttaagttacccgtaaccgtaccgtccgttacccgaagtaaccgtaaaccaaaccaaacgtaaacgttaaactttacgttaacgtattaccgtataacgtaaactacggtaaacnccgtacacggtacgacggaccgaacgtaccgaccggttactacgttacttacgttacgtacggtcgtacggttacgtaagggtttaccggaagtttacggtccgtaaccggttaccgtacgtaggtccgttaacccgg

SEQ ID NO: 106074 - DNA, 848 bp, Homo sapiens
  misc_feature: GYAE6OF02JV32E.49.42.D09.1.454.CMB.1.raw
  modified_base (200)..(200): a, c, t, g, unknown or other
  misc_feature (200)..(200): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttgggttttccttgttgcttattttagaggtcgtcccttgtcaagtncagcgtggtggagttcggtagggggtaaaggtggtcgaagggtcccgggggggtccctagacgaccgtcgtccgtgtgccgacgccttcgtggtattccctaccgtttcccgtttccctaacgtaccctacttagaaccgtaggtaccgtacccgccgaacgggtcctacccggaggggaccggtaccggtacggtacgggaggttcggggtaccttaccgtattaccgttaaggtttacggtagggtaaggtaggtacgttaacttaaccgtaaccgtaacgtacgtaccgaaggtactaccgacggttacgggcgggtaccgtactttacccgaaccctagtccccgttacaacggaaccgaaacccaaacgtaacctaaaggttaaaccttttcggtaacgtttacgtcctaacgtaaacgtaacctacgggtaactacgtacccggtaagaaccgggtacccggtaacccgggaaacgtaccggtaacccgtacgtttaccggggttaacttaacccgttttcggtttaaccgggaggttaaccgggaacgggtttttaccggggttaaacccggaggttttacgttaacccgggttaccccggttaccggtaaacccggtaccgtttacggttaaccccccgg

SEQ ID NO: 106075 - DNA, 857 bp, Homo sapiens
  misc_feature: GYAE6OF02HZ5T2.49.42.D09.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcacagtggaactgggctcgcttgggttttccttgtgtctatttagaggtgttcccttgtanagtcngagtcgtggtggtggtacgggtagggggtaaggtggtacggtaaccgggggtcccgggggtcctaggacgtacctctcgtggcacgacgtctcgtagtacttacccgtacctttccgttacactactatacgtacgtggaccctccgaccggtagtccgtacgggagggacggtcacggtggaggttccggtatctagtacgttaggttacggttaggtaagtacggttataacgtaaccgttaacgaaaccgttcggacgtaaccgtaccgttaccggtaaccgggtaggggtaaccgggtaccttaactacccggtaccttacggttaaccccgtacgaaacggaaactaaacccggaaaaccctaaaaccgttaaagttttaacgttaaccgttaacgttaccttacggtaaccgttaaagaacgttaaccggacgtaaccggtccggtaaggaacccgggttaaccgacccgggttaacctacccggggtaacgtttaaccggttttaacgttacgtttaaccggtttccggttacgggtaaacggttaccggggtttaaacgggacgggtttttaacggtaaacgttttccgggttaccccggttaaccgggtttacccgggtaacggtaccggttaacccttaaccccccgggg

SEQ ID NO: 106076 - DNA, 781 bp, Homo sapiens
  misc_feature: GYAE6OF02H2FZ3.49.42.D09.1.454.CMB.1.raw
  modified_base (717)..(717): a, c, t, g, unknown or other
  misc_feature (717)..(717): n is a, c, g, or t
  modified_base (745)..(745): a, c, t, g, unknown or other
  misc_feature (745)..(745): n is a, c, g, or t
tcagagtcgagagacacgaccggtgctcgatttagacacatacgcagggaaaggggagctctgagagaggagccttagcctggattccaaggcctatccacttggtgatcagcactgagcaccgaggattcaccatggaacgtggggcctccgcttgggttttccttgttgcttattttagaggtgtcccttgtcagtgacagcgtggtggagtcggtagggggaaggttggacgaacgggcccggggggtcctggacgactccgtccgtgtcgacgtacgtcccgtcttaggtattcccgtaccctttcccgttaccttacgtaaccctagtacggtaaccgtcggtaccctccggaccccgacggtcccgtaccgggaggggaccggaccgtacggtacgggtacggggttcgggtctaccggtacttacgttaaggttaggttaggtaacggtaggttagtaacttaaccgtaaccgtaaaccgtacggacgtaaccgaccttacggaccggtacgggtaacggggtaccgtaccgtttaccgaaccctacgtttaccccgtaccgaaacggaaccgaaaccctaaaaccgaaaccgttaacgttaaactttaacggttcggtaaacttccgtaagtaaacgtaaagtacccggtacacgtaccgttaggaaccgtaccgacccgacgtaaccgcgttacgtacttacgttacncgttagcgacgtaccggtggttaccgtntacggttacggtccgtacgtactcggtactacccgg

SEQ ID NO: 106077 - DNA, 761 bp, Homo sapiens
  misc_feature: GYAE6OF02HQO7L.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactgggctccgctgggttttccttgttgctatttagaggtgtcccttgtcaagtgcagctggtggagtcgtgggggaaaggtggtcgaaggtccgggggggtccctaggagtactctcctgtcgcaggcctctggattccaccttccgttcctataccatagaactggactccgaccaggcctaccgaggggacggcgtaccgtgggtagtgggtctacacttacttagttagtggtaaggtaggtgtaacgttaaccgaactaaaccgttacggacctaaggtacctcgtaaccgtggggaacgggtacccgtaactttaccgaaccccgtattccctaccgaacggtaaacgaaacctaaacccgaaccgtaaaacggttaaattttaccggaaggtttaactacccgttaagggaccctaaaaaggttgggaaaccctacgggttaccccgttggaaacggtaccggaacccggtaacccggaaccgacccggggtccttaacgttccgttaagttttaccgtcggttacgggtaccgaaagggttccgggtttaccggggaaacttggtttacccggcccgtttaaccggtccccgtaaggtacccgttaccccggg

SEQ ID NO: 106078 - DNA, 637 bp, Homo sapiens
  misc_feature: GYAE6OF02F2NBD.49.42.D09.1.454.CMB.1.raw
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggttttcctgttgctattttagaaggtgtcccttgtcaagtgcagctggtggagtcgtgggggaaaggtggtacaaggccgggggggtccctggagactctcctgtgcagcctctggattcaccttccgtcctataccatgaactggatccgccagggctccgaggggacggcgacgtggagtgggtctnatctataggtggtagaggtnagttactacaactacgcagactcacgtgggacgggccgtagtccaaccatcctccaaggacgaaccaaacaaccctaaaggaattttaccgtagttatcgtacgacgtaaatcggaacacgtccgtagaacgacggtacccgaacgtaaccgacggtccttacgggtacctttaagttaccgtgtcggggacccgtaagggtaaccgggtttcggggaaatttacggtttaccggacccggttaacgtcccccgtaagggttcctacccggg

SEQ ID NO: 106079 - DNA, 634 bp, Homo sapiens
  misc_feature: GYAE6OF02JY3R5.49.42.D09.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
tcagagtcgagagacacgaccggtgctcgatttagacacatacgcagggaaaggggagctctgagagaggagccttagccctggattccaaggcctatccacttggtgatcagcactgagcaccgaggattcaccatggaactgggctccgctgggtttccttgttgctattttagaggtgttcccttgtcaagtgcagcgtggtggagtcgtgggggaaggtggcgaaggccggggggtcctgacgctctaccgtgtgcacgcctctggattcctaccttccgttactataccntacgactggactcccncgacggctaccgagggcgcgacgtggacgtggtctcgatctattaggtggtacgtgtagtacttatactacgtacgactagactancggtaggacggtccgtatacgacctctactccgaanaacgaacaaactaacccgtaaagttaaactttacgttaacgtattacgtaacgactaaacggtacggaacgacgtccgaaggtaaccgacggtacccgaacggacaaccggccgttaagtcttagttacgtcggtaggacgtaggtacggtacggttacttaggttccgtacggtagtacccgaggttaccgttaacccgg

SEQ ID NO: 106080 - DNA, 650 bp, Homo sapiens
  misc_feature: GYAE6OF02FVHGG.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgctgggtttcctgttgctatttagaggtgtcccttgtcaagtgcagctggtggagtcgtgggggaaaggtggtcgaaggccgggggggtccctggacgactctctgtgcagcctctggacttcacccttcgttcctatacccatgaacgtggactcccgccacggcctccgaggggacggcgacgtggacggtcgggtctctagtcttattaggtggtaggtaggtgattactaacaactacgacagtactcgacgtcgggacggtaccgtagttccaacctacttaccgtaccgaagtaacgaaccctaaaccaaccgtaaaacgtaacttttaactaggtaccttactacgtaactaaacgttacggaaacctggtacccgtaggaaccgtacggacccggaacgacgacggtctagttacctacgttacgagtcggacggtacggtacggttaggtacttagtcggtaccgttacgcccgtagtacgttaccccgg

SEQ ID NO: 106081 - DNA, 752 bp, Homo sapiens
  misc_feature: GYAE6OF02G3B0X.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcgtgggttttccttgttgcttattttagaaggtgtcccttgtcaagtgcagctggtggagtcgtagggggaaaggtggtcgaacgggccgggggggtcctggacgactcgtcctgtgcacgcctcgtggtactttccacccgtttccgttccctactaacccatacgaacttggaccttccgccaggtcctaccgaggggacggcggactgggaggtcgggtctactattcctaagtttaggtggtaaggtaggtagtacttaactaacgtaaactacgaacgaccgtactcacgtacggggacgggacccgtacttccaaccgtatccctacgaagaaccgaacaaccaactaaagtaactttaccgtgttactactagactaaacggtcggacctaagtcccgtaggaacgtaacccgggtacccgacccgggtaaacggtaacccgtcgtttacggtttaccgttaacctttaggtacggttcccgggtaaggttaacggggttacgggtttaaaccgggttaacttacggggttttacccggaacccgggttttacccggttaaccccggttaaggtcccgtttaaacccccgggg

SEQ ID NO: 106082 - DNA, 845 bp, Homo sapiens
  misc_feature: GYAE6OF02HXBU9.49.42.D09.1.454.CMB.1.raw
  modified_base (97)..(97): a, c, t, g, unknown or other
  misc_feature (97)..(97): n is a, c, g, or t
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
tcagagtcgagagacacgaccggtgctcgatttagacacatacgcgagggaaagggagctctgagagaggagcctagccctggattccaaggcctancctactggtgatcagcactgagcaccgaggcttcaccagtggaactggggctccgntgggtttcctgtgcttatttagagtcgtccttgtcaagtgcagcgtaggnggacgttcggtagggggaaagtcggtcaacggggcccggggggttctggagacctctcctggtcgccaagtcctgtacggacttcccgtacctttcccgttcaactaccgattacgaacgtcggtaactccgccgaggttcccgaccgagggtacggtcgtcgtacgggtaggtcggtacctccgtaaagtcgttaagtttaggtagggtaaagtaggggttccgtaactttaaccgaacgttaaaaccgtaccggaccgtaggtaccccttaagaccgggtacgggtaacggccccggtttaagttccccgaaacgtttactaccccgttaaacccgtaaggggaacccaaaccgtaaacccgaacgtttaaaagtttaaacccgttttaaacggtacctttaagttccttaacgggaaaacgttaacggtaaccgggactttaaaccgggccgtttaacgggaaaccggacccggttaaccggaacccgttaaacccggacgttaccggtttacttaccggttaccgtttacggtaggtacccgggaacgttacggggttaacccggttaaggttacgttaaccgggttaccgtaacccggtttaacccgggtacctccgggttaattaaccccccgggg

SEQ ID NO: 106083 - DNA, 694 bp, Homo sapiens
  misc_feature: GYAE6OF02HPPR4.49.42.D09.1.454.CMB.1.raw
  modified_base (207)..(207): a, c, t, g, unknown or other
  misc_feature (207)..(207): n is a, c, g, or t
  modified_base (276)..(276): a, c, t, g, unknown or other
  misc_feature (276)..(276): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
tcagagtcgagagacacgaccggtgctcgatttagacacatacgcagggaaaggggagctctgagagaggagcttagccctggattccaaggcctatccacttggtgatcagcactgagcaccgaggattaccaccatacggaactggggcctccggcttgggttttccttgttgtcttattttagaaggtgtcccttgtcaagtgnacgctggtggacgtcgtaggggaaacggtggtacgagggccggggggtcctggaggactctcctggtancgagtcctcgtaggacttaccaccttccgtacctactacatgacgtggacnccgacaggctcgagggacgngacgnggtaggtcggtntacgagttcgtaagtacggtagacggtagtagtaacttactaactaaccgtacgacgtaataccgtacgacgtacgggcgggtaacctacgtttaccacccgtaagttccgtaacgtaaccggtaagtaaacccgaactaaaccggtaaacttaaaccgtttaccggtaagttaaccgttaacgacggtaacctaaaaggtacggaaccgttacgacgtacggtaacgcgaacccgacggtaccgactccgtagtaccttagttcgtacgttaggccgttagtacggtagtaacgttgtacgtaccgtaaccgtcgtacgtagtaccccg

SEQ ID NO: 106084 - DNA, 694 bp, Homo sapiens
  misc_feature: GYAE6OF02HOOHU.49.42.D09.1.454.CMB.1.raw
  modified_base (417)..(417): a, c, t, g, unknown or other
  misc_feature (417)..(417): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (507)..(507): a, c, t, g, unknown or other
  misc_feature (507)..(507): n is a, c, g, or t
tcagagtcgagagacacgaccggtgctcgatttagacacatacgcagggaaagggagctctgagagaggagccttagcccgtggattccgaaaggcctaatcccgactttggtgatcagcactgagcaccggaggattcacatcggaacgtgggcctccgtcgttgggttttccttagttgactttagttttaagaggttcgttcccttgacaaggtgcgtagcgttgggtaggagttcggtaagggggaaggttggtacgaaccggggccgggggttcccaaggtacgtaccgttcgtcgtgtcgctacggtccttgacgttagttcccttaaccgtttccgtaactactaacgtagtcgaacgtgaaccgtccgacgacgtccgtacggagggcgacgtcgtagggtgtccggtnagtaactcgtagttgaggtacgtagtctaataccacacgtcganacgtnacgtagcggcgtctagtaccacactatacagtacaccgaanacgtaaacgttacgtacagttacgtacgtaacgagtaaacgtacctaacgacctaggtacgtacggaccggacgtaccgtaaccgtcgagtttacgtcgtacgtttaccgaggttacggtacggttaacgtacggttagtaacggtttcgtacgtaccgttaacgtccgggtaacttccggtaaccg

SEQ ID NO: 106085 - DNA, 668 bp, Homo sapiens
  misc_feature: GYAE6OF02FNBRO.49.42.D09.1.454.CMB.1.raw
tcagagtcgagagacacgaccggtgctcgatttagacacatacgcagggaaagggggagctctgagagaggagccttagccctggattccaaggcctatccacttggtgatcagcactgagcaccgaggattcaccatggaactggggctccgctgggtttccttgttgctatttagaggtgtcccttgtcaagtgcagcgtggtggagtcgtagggggaaaggtggttcgaaggtcccgggggggtccctaggacgctcgtcctgtcgcacgcctcgtggtattctacctttccgtcctataccatagaactggactcccgaccgaggctaccggaggggaggtccgacgtgggagtcggggtctcgtatcttagttaggtaggtagtaggtgtattactacgaactcgacgtacgactacacgtccgggaacgggtccctaacgttaccaccgtacttacccgaccgtaacggaacgaaccgaaacctaaccgtaaagttaacttttaccgttaagttacttacgtaacgtactaaacgtcggtaacctagtacccgtagaaccgtacggaccgaacgacgacggcttacgtacttatacggtggtacgacggtaacggtggttacggtattcgttcggtacccgtaggacctaggtcttacccgg

SEQ ID NO: 106086 - DNA, 769 bp, Homo sapiens
  misc_feature: GYAE6OF02JFC2A.49.42.D09.1.454.CMB.1.raw
tcagagtcgagagacacgaccggtgctcgatttagacacatacgcagggaaaggggagctctgagagaggagccttagccctggattccaaggcctatccacttggtgatcagcactgagcaccgaggattcaccatggaactggggctccgcttggtttccttgtgctatttagagtgtccttgtcaagtgcagctggtggagtcgtagggggtaaaggtggtacgaagggcccggggggtaccctggacgtaccgtctaccgtggtcgcgacgccttcgtacggtacttcctacccgtttcccgttacctaactacctagtacgtaacgtgggtaaccttcccggaccgtaacggtcctaccggacggggtacggtaccggtacggtgggtacggttcgggtcctagacttacgtagttaggtacggtaggtacggttacgtaattaaccgaacgtaacgtacggtacaacggtacctaccgtacggtagggaaccggggtaccctaacggtttaccaacccgttacttacccgtaaccgacggtaaacctaaaccgaaccctaaaccgtaagttaaaccgtttactacgttactactacgaacgtaacgtacgacgtacgtaccgtagtaacgaccgtaccgaaccgaccggtacgtccgttacttacgttacgttacggtcggtaacggtacggtaacggtacgtttaacggtaacttcgggttcccggaaccgttaccggtaccctaggtcccgttaaccccgg

SEQ ID NO: 106087 - DNA, 725 bp, Homo sapiens
  misc_feature: GYAE6OF02H2PBJ.49.42.D09.1.454.CMB.1.raw
  modified_base (665)..(665): a, c, t, g, unknown or other
  misc_feature (665)..(665): n is a, c, g, or t
tcagagtcgagagacacgaccggtgctcgatttagacacatacgcagggaaaggggagctctgagagaggagccttagcctggattccaaggcctatccacttggtgatcagcactgagcaccgaggattcaccatggaacgtggggctccgcgttgggttttccttgttgtcttatttaggaggttcgtcccttgtacagtgcagtcgtgggtggaggtcggtaggggggtaaaggttggtacggaacggggtcccggggggggttcctggaacgtccgtccgttccgtggtacgcgtacgtcctcgtaggtacttcctaccctttccgttacctactacctagtacgacgtcggactccgcgacgcctcggaggacggcgacgtggacggtggtctctatcgtagttacggtggtaggaggttgtaacttacgtaacctaacgtacgacgtacgtacgtacgtacgggtacgggtacgggtacccgttaacttaccgaccctacgttcccgtaccggaacgtaaccggaaaccctaaacgtaacccgtaaagttaaaccttacggttagttaactcgtacgtaacgaagtaacgacgtaccgtacgacggacgtaacccgccgaaacgtccgaacgtcgttacgttaactcgttaggtacggngtacggagtaccggtttcgacggttctacgggcccgttacggcctaggtccttaaccggg

SEQ ID NO: 106088 - DNA, 659 bp, Homo sapiens
  misc_feature: GYAE6OF01BDKDC.12.3.A03.1.454.CMB.1.raw
  modified_base (255)..(255): a, c, t, g, unknown or other
  misc_feature (255)..(255): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctcagcgtctcgggacccccggcagagggtcacctatttcttgttctggaacccactccaacatcggatataattctgtanactggtaccagcagccttccaggacgccggcccccgactcctcacttctttaaataacaatcacgccggccctcgacggggtccctcgaccgtattcctcgtcggctacctaagtcgtcggccacctcacgtccctcccgtcggccctactcgaggtcgggtccttaccgagttcgtggagagtggaggtctagtaatttattacgtggtcgtctagtctaaggttcgggactacgacccgtaccctcggtaccgtcggggtccgggtaagttcgggtaccgggacgggacgggtaacccgaaggtccgtacggtaccccggttacgtacgggttccaaccgggtaccccgaaacgggtcccaccccgggtaccccccgttcgggtcccgtacccgttccccgg

SEQ ID NO: 106089 - DNA, 524 bp, Homo sapiens
  misc_feature: GYAE6OF01BKFHH.12.3.A03.1.454.CMB.1.raw
  modified_base (211)..(211): a, c, t, g, unknown or other
  misc_feature (211)..(211): n is a, c, g, or t
  modified_base (455)..(455): a, c, t, g, unknown or other
  misc_feature (455)..(455): n is a, c, g, or t
  modified_base (482)..(482): a, c, t, g, unknown or other
  misc_feature (482)..(482): n is a, c, g, or t
tcagatacgacgtacacgaccggtgctcgatttagagagcgtcacagagaggaagggggagtctccctcactgcccagctgggatctcagggcttcattttctgtcctccaccatcatggggtcaaccgccatcctcgccctcctcctggctgttctccaaggagtctgtgccgaggtgcagctggtgcagtctgaagcagaggtgaaagngcccggggatctctgacgatctctgtaagggttctggatacgactttcccaccactggatcggctgggtgcgccagatgcccgggaaaggcctggagtggatggggatatctagtcccggtgtactttgataccagatacagtcgtcattccaaggccagtcaccatctcagtcgacagtccatacaacaccgctaccgtgaagtggagagccgtggacggccgcggacaccgcatgtattacngtgcgagactcgacaaatcgtacgaanaaaggattaagttgttacttttaccagtttcgccttccctcg

SEQ ID NO: 106090 - DNA, 571 bp, Homo sapiens
  misc_feature: GYAE6OF01EC7Y6.12.3.A03.1.454.CMB.1.raw
  modified_base (306)..(306): a, c, t, g, unknown or other
  misc_feature (306)..(306): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaacgccccccaactcctgattttangacggtcacttattcggtcctcaggtaatttctaatcgctttctctggttccaagtctggacaacacggtccctcctgaccatctcgtggggtccaggtctaggacggacgaggtctagtatttattactgactagttcatatacaagtctacttcactcgtcgtggtcgttcggcggtaggaccagtctacgaccgtcctaagtccgacgtcccgaaggcctccggccccctggtccactcgttccgttccccgtcccttaccg

SEQ ID NO: 106091 - DNA, 722 bp, Homo sapiens
  misc_feature: GYAE6OF01EEKUF.12.3.A03.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagcccaccctcagcgtcgtcggggacccccgggnaggagggtcacctattttccttgttctcggaaccccactaccaacactcggatataattctggtanactggtaccagcagcttccaggagccggcccccgactcctctacttctttaaataaacaacttccacgccggtccctcgaccgggggtaccctcgtaccgactttcctcgtcgggtcctccgaacgttccttcgggaccctacccttccgaccgtccccgttcccgtcgggcccaacgttccgacggttcgggaccttccgacgttccgtggaagggtactaggacggtctaggtaatttactttacgtgtcgtctatcgagttcgggacttcgaaccgtaccctggaccggttacgggttacccgggtaggtttcgggttaccgggcgggtaaccggggaccgtacggtaccgttccggtacccggtaccggttacgggttcccgaaccgggtccccgaaacgggtccccgtaacccggcccccccggttacgggtccctaccgtttcccccgg

SEQ ID NO: 106092 - DNA, 616 bp, Homo sapiens
  misc_feature: GYAE6OF01CWFHB.12.3.A03.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
tcagatacgacgtacacgaccggtgctcgatttagagagcgtcacagagaggaagggggggtagagaagacaggactcaggacaatctccagcatggccagcttccctctcctcctcaccctcctcactcactgtgcagggtcctgggcccagtctgtgctgactcagcccaccctcagcgtctcgggacccccgggcagagggtcaccatttcttgtctcggaaccnctccaacatcggatataattctgtagactggtaccagcagcttccgaggacgccggcccccgactcctcattactttaaanaacaatccagccgaccctcgacgggtccctgaccgtattcctctggctaccaagtctggcacctcacgccctcctggcctatcgaggttcggcctccaagtctggacggatggaggtctggtaatttagttactgtacgtcattacgaagttcggggactacggaacctacccggttgacccggttgggtacccgggtagttcgggttcgggacgggtacgggaacctaggccgttacggacccgtaccgtaggtccaaccggtaccccgaaggcccaccggcccccgttcggtctacccgttcccg

SEQ ID NO: 106093 - DNA, 582 bp, Homo sapiens
  misc_feature: GYAE6OF01A4Z32.12.3.A03.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (419)..(419): a, c, t, g, unknown or other
  misc_feature (419)..(419): n is a, c, g, or t
tcagatacgacgtacacgaccggtgctcgatttagagagcgtcacagagaggaagggggggtagagaagacaggactcaggacaatctccagcatggccagcttccctctcctcctcaccctcctcactcactgtgcagggtcctgggcccagtctgtgctgactcagccaccctcagcgtctgggaccccccgggnagagggtcaccatttcttgttctggaacccactccaacatcggatataattctgtagactggtaacagcagcttccaggagccggccccccgatccncatctttaataacaatcagccggccctcgacggggtcccctgacccgattcctctggcctccaagttcctcggccacctcacgccctcccgtggcccatcaggtgggcctccgagtctggacggntgacggctgatttagtactgtgctatcagtgggctgacctaccctgtaccgtgggtccgggtagtcggttacgggcgggacgggtaccaaggcgtacggtcccgtcccgtagggtccacggccccaagggtccctcccggccccccgttggccctcgttcccg

SEQ ID NO: 106094 - DNA, 894 bp, Homo sapiens
  misc_feature: GYAE6OF01C5V65.12.3.A03.1.454.CMB.1.raw
tcagatacgacgtacacgaccggtgctcgatttagagagcgtcacagagaggaagggggggtagagaagacaggactcaggacaatctccagcatggccagcttccctctcctcctcaccctcctcactcactgtgcaggtcctgggcccagtctgtgctgactcagcccaccctcagcgtcgtcggggacccccggcgaggacgggtcacctatttcgttgttccgtacggaacccctactaccaaactagtaccggtaattaattaaactttccgttaggttaaacggtaaccgttacgggttaaaccccgaaggaccgtaacggtcccgttttaccccggaaaggggaccgggtaccccccggggacccccccccggtaacttcccccttacgttaaccgtttaacctttttaaaaaactaaaccgtaaaacttccgaaccgggtaccccgggtcccccgttacgggtaacccgggggtttccccctacggtaacccggttactttcccgtcgttcgggtacccttaccgtaaacgttccgtacgggtcccaaccgtcccgtacgtccccgtcccgtcgacctacgtcgacggtcggtcctccgagtcgtggacgtagtcgaacggtcgttaagttagttacttacgttgtacgactacgtcgtaacggttcggggacctaaccggtaaccgtacccggtttacggtaccggggttccggggttaccggggttaacggtttcgggggttacccggggaccggggtaaaccgggaccgtaccgggtccggtacccgggtaccccgttaccgggtacggtaccgacccggtaacccggaaacggtccccgtaaaccccggtcccccggtcggttacccgtccgtttaccccgg

SEQ ID NO: 106095 - DNA, 745 bp, Homo sapiens
  misc_feature: GYAE6OF01DD315.12.3.A03.1.454.CMB.1.raw
  modified_base (256)..(256): a, c, t, g, unknown or other
  misc_feature (256)..(256): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctcagcgtcgtcggggacccccgggcaggagggtcaccatctcttgttctcggaacccactaccaacatcggatataattcngtagactgtaccagcagtccttaccgaggacgcccggccccccgtactccctctacttactttaaactaacaactcgacgcccggccctcggacggggtccccccctgaacccgtacttcctcgtcggtcctacgtaacgtcgtcggcctacctcacgtccctcccgtcgcctatccgaggtcgggtctaccgacgtccgtgaggtagtaggtacggtacgttaggtaactttacgtttacgtggtacgtctagttaccgtaggtcggtcgttaccgaccgttacccgtcggtaaccggttcggggtacccggggttacgggtttccggggttaccggggtaccggggtaacggggtaacccggtaacggtacccggttccgggtaacccggtttacccggttaaccgggtaaccggtaacccggtaaccccggaacgggtaccccgtaccccgggtcccccccggtccgggttaccccgttaccccgg

SEQ ID NO: 106096 - DNA, 633 bp, Homo sapiens
  misc_feature: GYAE6OF01DS7RL.12.3.A03.1.454.CMB.1.raw
  modified_base (246)..(246): a, c, t, g, unknown or other
  misc_feature (246)..(246): n is a, c, g, or t
  modified_base (391)..(391): a, c, t, g, unknown or other
  misc_feature (391)..(391): n is a, c, g, or t
tcagatacgacgtacacgaccggtgctcgatttagagagcgtcacagagaggaaggggagcttcagctgtgggtagagaagacaggactcaggacaatctccagcatggccagcttccctctcctcctcaccctcctcactcactgtgcagggtcctgggcccagtctgccctgactcagcctgccctccgtgtcgtgggtctccgtggacagtcgattccaccatcctcctgctacgtggaaccngcagtgacgttggtggttataactatgtctcctgtaccacagcaccagcagacgaccccaatcatgtattttgatgtctactaatcggcctcgtagggttctgatcgtcttctcgtcggtcctactaacgtcgtcgtacctaacncccggtccctaccctcggtaccctacgttccttacggtcggtcctcccgaagggtccgtggaacgggacgtacgggtctttacgtaattttacttagtttcgtacgacgttaccttctaacgttaactaacgtaaacgcgaacgcccgtaacggtcccctttaacccgtttcgttttcggtacgtttaacgggtaacgggtaacggtacccgttaaacgggtcccttacccggttaaccccg

SEQ ID NO: 106097 - DNA, 602 bp, Homo sapiens
  misc_feature: GYAE6OF01E1GDN.12.3.A03.1.454.CMB.1.raw
  modified_base (306)..(306): a, c, t, g, unknown or other
  misc_feature (306)..(306): n is a, c, g, or t
  modified_base (412)..(412): a, c, t, g, unknown or other
  misc_feature (412)..(412): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatttcttgttctggaacccactccaacatcggatataattctgtagactggtaccagcagcttccaggacgccggccccccgactcctcattctttaanaacaatcagccggccctcgacggggtccctgaccgattctctcggctccaagtctggccacctcacgccctccctggcccatcgagtgggcctccagtctagaggntgagctgatttatctgtgcatcagtggctgacctacccgtgacgttcgggtccgggagttcggttccgggcgggaacgggtacccgaaaggccgttacgggaccccgttaccgtacgggtaccacccgggaccccgaaaccgggcccgtaacccggtccccccgttccgggttccctacccgtttccccg

SEQ ID NO: 106098 - DNA, 618 bp, Homo sapiens
  misc_feature: GYAE6OF01DN96C.12.3.A03.1.454.CMB.1.raw
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctcagcgtcgtcgggacccccgggcaggagggtcacctatttcttgttctcggaacccactccaacatcggatataattctgtagactggtaccagcagcttccaggacgccggccccccgactcctcattctttaaactaacaatcagccggccctcgacggggtccctgacccgtattcctcgtcggcctaccaagtccgtcggaccacccttcacgtccctcccgtcggcctatcaggtcgggcctccgagtctaggaggtatggaggtcttaggtatttagttactgtcgcattccgagtcgggctacggaccctacccgtggtaccgtgggtacccgggtagttcgggttccgggacgggtacggaccgaggcgtacggacccgttacgtacggtccacggcccgaaggccacccgtcccccgttggcctccgttcccg

SEQ ID NO: 106099 - DNA, 732 bp, Homo sapiens
  misc_feature: GYAE6OF01C5KN7.12.3.A03.1.454.CMB.1.raw
  modified_base (234)..(234): a, c, t, g, unknown or other
  misc_feature (234)..(234): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctcagcgtctcggggacccccgggcaggagggtccacctatttcttgttctcggaacccnctccaacatcggatataattctagtagactggtaccagcagtcttccgaggacgccggcccccgactcctacacttactttaaaataaacctaatcgaacggcccggcccctacggtaccggggtccccttaggaacccggtactttccgtccgtcggccttaccgtaacgttccgtcggaccacccttcacggtcccctccgtcggacctaacgtcgtaggtcgggacctccgagttccgtaggtaacggtatacgggtacgtacgtttaggttaactttaacgtttacgttcggtacgtactagttacgtaacggttcgggcgttaacggaacccgtaacccggttcggtaaccggttcgggggtaccgggtaaggtttcgggttacgggacgggaaccgggtaaccacggtccgtacggtacccgttacgtacgtcccggaacgaccccgacggtcccgtacccgtcccccgttacgtcccgttccgttccccgg

SEQ ID NO: 106100 - DNA, 740 bp, Homo sapiens
  misc_feature: GYAE6OF01CE2BC.12.3.A03.1.454.CMB.1.raw
  modified_base (239)..(239): a, c, t, g, unknown or other
  misc_feature (239)..(239): n is a, c, g, or t
  modified_base (729)..(729): a, c, t, g, unknown or other
  misc_feature (729)..(729): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcaggtcctcgggcccagtctgtgctgactcacgcccaccctcagccgtcgtcggggacccccgggcaggacgggtcacctattttcttgttctcggaacccnctaccaacatacggatataacttctgtagacgtggtaccagcagtccttccgaggtacgcccggccccccgtactcctctaacttactttaaataacaacttccgaggtccggtcctcggacggggttccctacgaccgtacttccgtcgtcggtccttaccgtaagtcctcggaccacctcgacctccccgttcccgtacggtaccctacgttacgtcgggtccgggtacccttacccggtaacgttccggtaagggaaggggttaacgttcgggtaacggggttcctttaaggtaaacgtttttacgttaaccgttggttacgactacgttccgtaggtcgggtacctacgacccgtacccgttggtaccggttggggtcccgggtaggtttcgggtccgggacgggggtaacgtaccgagtccggtacgtcccggttcgacggtccaacggacccgacggtaccgaccccgtccccgtccggtaccnccgtttaccgg

SEQ ID NO: 106101 - DNA, 712 bp, Homo sapiens
  misc_feature: GYAE6OF01AX8TZ.12.3.A03.1.454.CMB.1.raw
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
tcagatacgacgtacacgaccggtgctcgatttagagagcgtcacagagaggaagggggggtagagaagacaggactcaggacaatctccagcatggccagcttccctctcctcctcaccctcctcactcactgtgcagggtcctgggcccagtctgtgctgactcacgccaccctcagcgtctcgggaccccccgggnaggagggtcacctatttcttgttctcggaacccactaccaacntcggatataattctgtanactggtaccagcagcttccgaggacgccggccccccgatccctcacttctttaactaacaatcgagccggccctcgtacggggtccctgacccgatttcctctcggcctccgaaagttcctcgggcctaccctccgacggtcccttcccgtcgggcccacgttcgacggttcggggtcccttcccgtaaggtccctagggaggtaacttgggaagggtaccttggtaacttttacgttacgttggtcgactactaccgtagttcggggctacgaccctaacccgtggtaccgttcggggtaccgggtaggtttcgggttccgggacgggtaaccgggtactaacgggtccttacgggtaaccccgttcccggttaagggttcccgaacccggaccccgtaaccgggtcccgtacccggtcccccccggttgggttcccgtacccgtttccgg

SEQ ID NO: 106102 - DNA, 1065 bp, Homo sapiens
  misc_feature: GYAE6OF01CER1J.12.3.A03.1.454.CMB.1.raw
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctcgggcccagtctgtgctgactcacgcccaccctcgagccgtcgtccggggacccccggcaggacgggtccacccttattttccgtttgttccgtacggaaaccccctacttacccaaaacgtagttaccggaatttaacttaacgtttccgtaggttaacgtaaccggttcggttaacccgacggtaccgtaacgttaccgtttaccccggaaggggaccgtacccccgggggacccccccgtaaccgtttccccgtaccgttaactttaaacccgtttttaaaacgtaaaacctaaaacgttacccgacgggtaccccggtacccccgttaccgggtaccgggggttaccccttacggtaacccgttaacgttttacccgtccggttcgggtacctttacccgtaaacggtttcccgtacgggtacccctaacccgttcccgtaacccggttcccccgttccccggttacccgggaccctttaaccggtaccggttaccgggggttaccgggtacccctttaacccggtaacgggttacccgtaacgggttaacggggttaacgtttacggggaaccgggtttaccgttaggtttaaaacgtttttaaccggttaccgttacgggttacggtaccctttaaacggtttccggaaacgggtttcggggtaaccccgttaccggtaaccccgttaacccccgggttaccgggttaaccggggtttacccggggggtttacccggggtttaacggggtttccgggggttacccggggaacccggggtaccggtaaaacccggtccgggtaccggtaccccgttacccggtacccggttaacggacccggtaacccgacccgtaaccgggtcccctacccgggtccccccggttacggtaccccgtccgtttaaccccccgg

SEQ ID NO: 106103 - DNA, 691 bp, Homo sapiens
  misc_feature: GYAE6OF01D7CTC.12.3.A03.1.454.CMB.1.raw
tcagatacgacgtacacgaccggtgctcgatttagagagcgtcacagagaggaaggggggggtagagaagacaggactcaggacaatctccagcatggccagcttccctctcctcctcaccctcctcactcactgtgcgagggtcctcgggcccagtctgccctgactcagcctgcctccgtgtcgtgggtctcctggacagtcgatcaccatcctcctgcacgtcgggaccagcagtgtagtggttgggacttaacttaaccttcgtcctccgttaggtaacccaacgacgaccacccaaggccaacggacccgacccccaaaactccagttgttattttgatcgtacactacgtccgtcctcgtagggtttctggtactcgtcttctcgtcgtcctacaagttcgtacgtaccgtaccgaccggtcccttacccgtacgtaccctacttccgttccggtcgggtaccctaccgtaggtccgtagggaacggaccggtaggtcttaagttacttaacgtttacgtcgacgtcgtactactaagttacgtcggacacggactagtaccgttaagtttcggtttcgtaccgtacgggtaacgtaccgggacccttacgggttcccgaacccggttaccggttaacggccgtaaacccggaccccgtaaacccgggtcccctaacccgtaccg

SEQ ID NO: 106104 - DNA, 906 bp, Homo sapiens
  misc_feature: GYAE6OF01DNQR7.12.3.A03.1.454.CMB.1.raw
  modified_base (207)..(207): a, c, t, g, unknown or other
  misc_feature (207)..(207): n is a, c, g, or t
tcagatacgacgtacacgaccggtgctcgatttagagagcgtcacagagaggaaggggggggtagagaagacaggactcaggacaatctccagcatggccagcttccctctcctcctccaccctcctcactcactgtgcgacgggtccgtcgggcccagtctgtgctgactcacgcccaccctcagccgtcgtcggggacccccggnaggacggtcacctatttcgtttgtttacgaacccacctaccgaactagtacggtaataagttaacttccgtaggtaacgtaccgtcggtaaccacgaccacgtccgttaccgaacgggaccggaccccggccccccgtactccccttactactttaacctttaaaataaacccgtaactaccgaccggtccccggtccccgtaccgggtaaccgggggttcccctacggtaacccgttactttcccgtaccgtaccggtccctaaccgtaacgttcccgtacggtaccctaacccgtccgacccgtccccttacccgtacgaaccctacgtccggtacggttccggacccttccggtaacgttccgtagggaacgggtacgtacggacggtacgttacgttaatttacggttaaccgttgggtacgtacctacgttccgtaagggttccggtacctaccgaaccccttacccggttacgggttaacccggttccggggggttaaccgggttacgggttcccgggttaccgggggacggggtaaacccgggtaaacccgtaaccgggtcccggttaccggtaaccccgggtttccggtaaaccggttaccccggaacccggtaaccccgggaaccggtaccccgtaccccgggttacccccgtcgggtaaccccttacccggtccccgtttaccccccgg

SEQ ID NO: 106105 - DNA, 738 bp, Homo sapiens
  misc_feature: GYAE6OF01DQZI7.12.3.A03.1.454.CMB.1.raw
tcagatacgacgtacacgaccggtgctcgatttagagagcgtcacagagaggaaggggggggtagagaagacaggactcaggacaatctccagcatggccagcttccctctcctcctcaccctcctcactcactgtgcgagggtcctcgggcccagtctgtgctgactcacgccacctcagcgtcgtcgggaccccgggcaggacggtcacctatttcttgttcgtacggaacccctactaccaaacacgtacggaattaattaacttcgtaggtacggtacgtacggtaaccagacacgtccttaccgaacgggaccggcccggacccccgtacctcctactaactttaacctttaaaactaaactaactacgaaccggtcccggtacccgtaccggtaccgggtacccctcgggaaccttacgtttccgtccgtacggtccgttaccgaacgttcgtccgacctacctcgtaccgtcccgtccgtcgacctacgtccgtacggtcggtccttaccgtacgttcggtaggaacgggttagtagggtacggtcttagttaacgttactttacgtggttacacgtacgtcgtaggtcggtacgtacgacccttaccgtgacgggttcgggtaacggttggttacgggtcggggacggtaacggtaccgacgtcgtccggtaaccggttcgacggtcgacgtacccgaacggtccgacccgtcccgacggtctcggtccc

SEQ ID NO: 106106 - DNA, 895 bp, Homo sapiens
  misc_feature: GYAE6OF01BNH3E.12.3.A03.1.454.CMB.1.raw
tcagatacgacgtacacgaccggtgctcgatttagagagcgtcacagagaggaaggggggtagagaagacaggactcaggacaatctccagcatggccagcttccctctcctcctcaccctcctcactcactgtgcaggtcctgggcccagtctgtgctgactcagccaccctcagcgtcgtcggggacccccggcaggagggtcacctagtttccttgttccgtcggaacccactccaacatacggaatataattctgtacgactggtaccagacagtccttccgaagggacgcccggccccccgactcccgtacactttaccttttaaataaacctaatccgacggcccggacccttccggacggggtacccctacgacccgtactttccgtaccgtcggcccttaccgtaaggttccgtacgggtacccacccgttaccgaccggtccccttacccccgtgggtacccctaacgttccggaagggttccggggtaccttaccccggtaacgttcgttaccgggaagggtaacgtttcggggaaacggttccgttaagggtttaaacttttaacttttaacccgggttagggttaccggtaaccccgttaattccgtaacgggtttccgggggtaacctttcccggaaacccccgttacccccggttagggtaacccgggtttccccgggggtttaaccggggttaccgggtttaccgggggttttacccggggaacggggggtaaaccccgggtaacccggtaaccgggtacccggtttaaccggggtacccccgtttaacgggtaccgggttacccgacccgggtaaccccgaacggggtaccctaaccccggttcccccccggtacgttacccgtccctttacccccggg

SEQ ID NO: 106107 - DNA, 839 bp, Homo sapiens
  misc_feature: GYAE6OF01DXMGD.12.3.A03.1.454.CMB.1.raw
  modified_base (206)..(206): a, c, t, g, unknown or other
  misc_feature (206)..(206): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcgagggtcctgggcccagtctgtgctgactcacgcccaccctcacgccgtcgtcggggaccccccgggnacggacgggtccaaccttattttcttgttctacggaaccctactaccaacagtcggaataattaattctagtaacgtactcggtaaccagcagtccttacgagggaccgcccggcccccgactcctctaactttactttaaaacaacaacttaccgacggcccgtcccgtacggaccggggttccctacggacccgtactttccgtcgtacggtacctaccgtaaacggttccttacggacctacccgttcaccggtccccttcccgtacggaccctagtcggacgggtcgggcccttaccgtaggttacccgtagggtacggtaagtcggtaacgtcgttaacggttattttaacgttacgtggttacgtactacgtacggtaacggttccggggactaccggtaaccccgtaccggttacgggtaccgggtttaccggggggtaccgggttacggtttaccgggggttacccggggaaaccggggtaacggggaaaccccgttaggtaacccggttcccggggttaaaccccggttaccggttaacgggacccggaacccgggtaccccgaaacgggggtcccctaccccgggtccccccgttttaacggaccttaccccggtttccccgg

SEQ ID NO: 106108 - DNA, 724 bp, Homo sapiens
  misc_feature: GYAE6OF01BCW8K.12.3.A03.1.454.CMB.1.raw
  modified_base (65)..(65): a, c, t, g, unknown or other
  misc_feature (65)..(65): n is a, c, g, or t
  modified_base (213)..(213): a, c, t, g, unknown or other
  misc_feature (213)..(213): n is a, c, g, or t
  modified_base (534)..(534): a, c, t, g, unknown or other
  misc_feature (534)..(534): n is a, c, g, or t
  modified_base (564)..(564): a, c, t, g, unknown or other
  misc_feature (564)..(564): n is a, c, g, or t
tcagatacgacgtacacgaccggtgctcgatttagagagcgtcacagagaggaaggggggggtanagaagacaggactcaggacaatctccagcatggccagcttccctctcctcctcaccctcctcactctctgtgcgacgggttccgtcgggcccagtctgtgctgactcacgcccaccctcgacgcgtccgtaccggggaccccccgggnaggacgggtccaacctattttcttgttcctacgggaacccactaccaaacataccggattaagtaacttcgtagtaacgtacgttacggtaccaggactacgtccttacgacggacggcccggaccccccgtactccctactacttacttttaaacaaacaacttcgaacgtcccggacccttacggacggggtccctacgtaccgtacgttcctcgtcggtacccgtacctaacgtccttcggacctaccttcgaccgtccgtaccctcggaccgtactacgacggttcggccttacgacgtacgtggacgttagtcggnggtactagttattactagtcgtagactagntacggtcgggtctacaccgaccgttaggaccgttcgggtaccgggttattacggggtcggaccgggtacgggtaactaccggccggttacggacccgtggtaaccgcgacccgacccggaaccgccggtacccgtacccacccggttatccccgttcccg

SEQ ID NO: 106109 - DNA, 799 bp, Homo sapiens
  misc_feature: GYAE6OF01AIE0Z.12.3.A03.1.454.CMB.1.raw
tcagatacgacgtacacgaccggtgctcgatttagagagcgtcacagagaggaaggggggggtagagaagacaggactcaggacaatctccagcatggccagcttccctctcctcctcaccctcctcactcactgtgcaggtcctggcccagtctgtgctgactcacgccacctcagcgtcgtcggggaccccggcaggacgggtcaccgtatttcttgttctcggaacccactccaacatcggattataattctgtacgacgttcggtaccagccagccttaccgagggtacgcccggaccccccgtactcccgttactacttacgtttaaactaaaccgaacttcaaccggtccggcccgttcggtaaccggggttccctaccggaaccgtactttcctaccggttcgggtaccttaccgtaaacggttccgtacgggtaccctacccgttacaccgggtaccccttcccgttcgggaacccctagtcccggtacgggttaaacggtccgtaccgtaacgttcgtagggacggtaggtacggacggttacgttagttaaacttttacgttaacgttcggttacgtacgtacgtccgtcgggtacgggaccgttccgtaaccgtaaccccgtggtaccgggttcggggtcccgggttaagtcggggttacggggaccgggaacgggaccgtaaggttcccgtaccgggtacccgttaccggtacgggtcccaaccccgggtaccggaaaccggtccgtacccccgtaccccgggtcttaaccgtcccgtttaccccgg

SEQ ID NO: 106110 - DNA, 773 bp, Homo sapiens
  misc_feature: GYAE6OF01EGML4.12.3.A03.1.454.CMB.1.raw
  modified_base (200)..(200): a, c, t, g, unknown or other
  misc_feature (200)..(200): n is a, c, g, or t
tcagatacgacgtacacgaccggtgctcgatttagagagcgtcacagagaggaagggggggggtagagaagacaggactcaggacaatctccaggcatggccagcttccctctcctcctcaccctcctcactcactgtgcagggtcctgggcccagtctgtgctgactcagccaccctcagcgtcgtcggggaccccggnagacggtcactatttcttgttctacgaacccactaccaacatcggattactaattctagtacgtacgtcggtaccagcacgtccttccgagggccgccggcccccgtactccctctactttactttaaataactactcgacggtccggaccctcggaccgggttccctacggaccgtacttctcgtcggtacctacgtaacgtcgtacggccacctcgacgtcccttccgtcggtacctacgtacgtacggttcgggtccttaccgtacgttccggtacggagggtacgttacgggacggtacttaaggtttaagttttaacgttaccgttgggttactaccgtacgttacgtagggttcgggtacctacggtaaccttacccgttacgggtaccggttacgggggttcccgggtaggtttccgggggtaccgggaaccgggggtaaccgggtaaccggtaacggtacccggttaccggtaacccgggttaccgtaacgggtccgacccgggtacccgaacccggggtcccgtaacccgtcccccgggttacggtcccgttccgttaccccgg

SEQ ID NO: 106111 - DNA, 780 bp, Homo sapiens
  misc_feature: GYAE6OF01A0EL1.12.3.A03.1.454.CMB.1.raw
  modified_base (165)..(165): a, c, t, g, unknown or other
  misc_feature (165)..(165): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
tcagatacgacgtacacgaccggtgctcgatttagagagcgtcacagagaggaagggggagctgtgggtagagaagacaggactcaggacaatctccagcatggccagcttccctctcctcctcaccctcctcactcactgtgcagggtcctgggcccagtctgngctgactcacgcccacctcagccgtcgtccggggacccccgggnaggngggtccacctatttcgttgttcgtacgaaccccactccaacngtcgtatattaacttctgtacgactcgggtaccagcagtccttccgaggacggcccggccccccgtactcccgtactacttactttaacaactaatacgacggtcccgtcccgtcgaccggggttcctcggaccgttattccgttcgtaccggccttaccgtaacgttccgtacggtaccctaccctaccgaccgtccccgttcccgttccggacccttacgaccgtcgggttcggtacccttacccggtacggttcccgtagggaacggtaggtacggtacgggtcttacggttaacttttacgttacgttcgggtcgtactacgtacgtggtacggtaccttaccgggtaaccctaccggttcgggtaaccggttcgggggtacccggttggggttaccggggttcccggggaacgggggtacccgggtaaccggtacggtaccggttccggttaacccggtacgggtaccgggtacccgaacggaccccggaacggtccccggtcccggttaaccccccggg

SEQ ID NO: 106112 - DNA, 760 bp, Homo sapiens
  misc_feature: GYAE6OF01B3A31.12.3.A03.1.454.CMB.1.raw
  modified_base (204)..(204): a, c, t, g, unknown or other
  misc_feature (204)..(204): n is a, c, g, or t
tcagatacgacgtacacgaccggtgctcgatttagagagcgtcacagagaggaaggggggggtagagaagacaggactcaggacaatctccagcatggccagcttccctctcctcctccaccctcctcactcactgtgcagggtcctcgggcccagtctgtgctgactcacgccaccctcgacgcgtcgtaccgggaccccggnaggacggtcacctattttcttgttccgtacgaaccctactacccaaacgacgtacgtaacgtattaaacttcgtagtacgtacgtacggtacacgcgtaacgaccttaccggaacggtccggtcccggaccccccgtaaccgtcccttacgtaactttaactttaaacgtaaacctaaactaccggaacggtccccggtcccctacggtaccggggtaccctacggtaacccgttacgtttactcgtcgtaccgtactaacgtcgtacgcctaccgtcacgtcctccgtcgacctatcggtacgtacggctacgtacgttcgaggtacgtagtacgtagtcgttagttaaactttgtaacgtcgtacgtacacgtactacggttcggactacgtaccgacttcggtaaccggttcgggttccgtacgggtttcggacgggtaaccggacggtaacccggtagtacccgggtaaccgtcccgttaacgtaccggtacgtaacccgaccggtaaccgtccaaccccgggtcccgttaaccgtccgtaacccttcccgg

SEQ ID NO: 106113 - DNA, 916 bp, Homo sapiens
  misc_feature: GYAE6OF01BAPEH.12.3.A03.1.454.CMB.1.raw
  modified_base (210)..(210): a, c, t, g, unknown or other
  misc_feature (210)..(210): n is a, c, g, or t
  modified_base (584)..(584): a, c, t, g, unknown or other
  misc_feature (584)..(584): n is a, c, g, or t
tcagatacgacgtacacgaccggtgctcgatttagagagcgtcacagagaggaaggggggggtagagaagacaggaatcaggacaatctccagcatggccagccttcctctcctcctcaccctcctcactcactgtgcgagggtcctgggcccagtctgtgactgactcacgccctaccctgacgccgttccgtcggggaccccccgggnaaggacgggtccaccgtattttcgtttggttcctacggaacccctacctccaaactacgttccgggaattaacttaatttccgtagggttaacgaccgttccgggtaaaccagggtaccaacggttcccttaccggaagggacccggtccccgggtacccccccgtacttccccgtactacctttaacgttttaaacgaaaacctaactccgtacggcccgggtacccgtaccggtaccggggttcccctacggacccggttaacctttccgttcccggtcgggtacccttaacccggtaaacgttccggttaccggacctaacccccggttccgtaacccgggtcccccctttacccggtacccggtaacccncggtttaccggtaagggtcccggggttactacccgggtaacggttccgttaaggggaacgggtacgttcggggtaacgttccttaagtaaacgttttacgttcgttggtaccggtaccgttattacgggaacggttcgggtaaccctcggtaacccgtaaccccggtcgggtacgggttaccggggtgggtttacgggtcggggttaacccggggaacggtcgggaaaaccttcgcggtaacccggttacccgttacgggtacggtaccacccgggtaccgaccggtacccgttacccccggaccggtttacggcccgttacccggttcccg

SEQ ID NO: 106114 - DNA, 795 bp, Homo sapiens
  misc_feature: GYAE6OF01ATQL5.12.3.A03.1.454.CMB.1.raw
  modified_base (591)..(591): a, c, t, g, unknown or other
  misc_feature (591)..(591): n is a, c, g, or t
  modified_base (768)..(768): a, c, t, g, unknown or other
  misc_feature (768)..(768): n is a, c, g, or t
tcagatacgacgtacacgaccggtgctcgattttagagagcgtcacagagaggaaggggggggtagagaagacaggactcaggacaatctccagcatggccagcttccctctcctcctccaccctcctcactcactgtgcgaggtccgtcgggcccagtctgtgctgactcacgcccaccctcacgccgtcgtccggggacccccggcgaacggtacgggtccaccttacttttcttcgttccgtacggaacccacctaccaacgagtcggtaattaattaacttcgtagtacgtacgttacggtaccagctacgtccttaccggacgggaccggtcccccggccccccgtacctcctacctaacgtttaactttaaaactaaacctaacgtaccgaccggtcccggtacccgtaccgggtaccggggttcccctacggaacccgttactttccgtcgtcggtacctaccgtaacggtccgtacgtccctaccctaccgtacccgtcccgtcccgtcggtaccctagtcgtacggtccggtacctaaccgtcgtacgtcgacgggtagtcgggaagttcgtagttaacttnttacgttgcgtactgtacggtcgtcggtacctcgtacccgttccgtacggtcgggttccggggtaccggttagggttccgggacgggtacgggaaccgtacggtaccgtccggttaaaccggtcccggtaaccggttacggacccggtaccgtaacccgacggtccccggtaccccnccccggttcgtacccgtcccgtacccg

SEQ ID NO: 106115 - DNA, 790 bp, Homo sapiens
  misc_feature: GYAE6OF01EJ72W.12.3.A03.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctcgagcgtcgtcggggacccccggnaggacggtcacctatttcttgttctcggaacccactccaanagtccggtattaattaattcgtagtacgtacgtacggtaccaaggcaacgtccttaccgaaagggccgacccggtccccccgtaacttccctactaacgtttacttttaaaacaacctaaacttcgaacggtccccggtacccgtccggtacggggtccccttacggaccgtacgttcctcggtcgtaccctacgaacgttccgtcggccctacccgtactaccggtccccttccgtacggtaccctaagttccgtaacgggtccgggtaaccctttaccgtaccgggttacgtacgggtaaccgggtagttacgggaaccggggttactttaacgggttaactttttaacgttaccgttcggtaactcccgtagtaccgtaggttccggtactaccggtaaccctccggttacgacgggttccgggtaccgggtggtttacgggtaccggacggggttaacggacctacggtcgtaccgtccggtactacggtaccgccgaaccgacgggtcccacccgtccccggtacggtccctaagttcccccgg

SEQ ID NO: 106116 - DNA, 721 bp, Homo sapiens
  misc_feature: GYAE6OF01BDIJK.12.3.A03.1.454.CMB.1.raw
  modified_base (198)..(198): a, c, t, g, unknown or other
  misc_feature (198)..(198): n is a, c, g, or t
tcagatacgacgtacacgaccggtgctcgatttagagagcgtcacagaggaggaaggggggggtagagaagacaggactcaggacaatctccagcatggccagcttccctctcctcctcaccctcctcactcatgtgcagggtctgggcccagtctgtgctgactcagcctaccctcagcgtctcggggacccccggnaggacgggtcacctatttcgttgttccgtaggaacccacttccgaacagtcggaatactaattcgtgtaacgtacgtggtaccagcagtccttcgaggtacgccggccccgactcctcatacgtttaataacagtcacgaccggccctcgacggggtccctggaccgtattccgtcgtcgggtcccttacgaacgttccgtcgggtacctaccctcgacgggtcccttcccgtggccctagtcaacggtcggggtacctccgaagttccgtacggtacggtacgtcggtacggcgttacggtaagttttaacgttaccgtggttcgactacgttacgagttacgggctacggtaaccaccgttacggacggttcgggttaccggggtggttacgggttccggggaacgggtaaccgggaccgtaggtccgtacgggtacccgtaccgtaacgggtcctaaccgggaccgtaaacgggtccgtaaccccgtaccccggttcccgttccggaacccgtttcccgg

SEQ ID NO: 106117 - DNA, 826 bp, Homo sapiens
  misc_feature: GYAE6OF01CKFNZ.12.3.A03.1.454.CMB.1.raw
tcagatacgacgtacacgaccggtgctcgatttagagagcgtcacagagaggaaggggggggtagagaagacaggactcaggacaatctccagcatcggccagcttccctctcctcctcaccctctcactcactgtgcgagggtcctcgggcccagtctgtgctgactcacgcccaccctcgagccggtcgtccggggacccccgggcaggtacgggtccaacctgtttccgttacgttccgtacggaacccctactacccaaacacgtacggtaacttaattaacttcgtacggtagtaccgtaggtacagtactacgtccttacggacgggaaccgtccccgggaccccctactccgtctacgttacttaaactaacgtaactcacggccgtcccgtacgggtaccgggtacctacggaccgtttaactccgttacgtcgggtaccctaccgtacgttacggtccggtacccctaacccgtcaacccgtcccccgtccgtaccggttacccacgttaccggacggttccggtccttaccgagtccggtaaggaaccgggtgtaacgggtacgttagtccgttaaagtttaccgtacgtcggtacgtaactagttaccgtcgggtacggacccgttacccggacctttaaccggttcggtaccgggttccggggttaaccgggttcgggttcggggtacccgggccggggtaacgggtaccccaaggggttcccgtaaccggtcccgggtttaacggtacggaacgtaccccgaaaccggtcggaccccggttccctacccccggtgtaccctccggggttcccc

SEQ ID NO: 106118 - DNA, 876 bp, Homo sapiens
  misc_feature: GYAE6OF02GQDNM.12.3.A03.1.454.CMB.1.raw
tcagatacgacgtacacgaccggtgctcgattttagagagcgtcactaggtagggagaaggggggtagaccgaagacctagggactccaaggacttaatcttccagcaattggccgaagcttaccctctcctccgtccaccctccctcacgtctacgtgtgcagggtccgtttcgggtcccagtctgtgccttaaggactccagtccaccctacagccgtacgttggggacccccggggcacggagggggtcaccctagttttacgttcgttcgggttcggtaaacccacttcccaacctagtccgggatacttaactttcgtagttacgaacctttggtaacctaagtcgacgtcgttaccagggagtccgggccccccgactccgtctactcgtttaagacagtcaggtcggacccttacaaaggggttaaccctggaacccgtagtttcgtacgtaaggtacctacccgtaaaggttcctacgggaccctaaccgtaacgaacggtccctttccccgtacggaccctaacttccgaaagggttcggggtaaccttacccgtaacggttaaacccgttacgggtaagggttaactttgggaacggtaacctttagggtaaacttttaacgtttaaccgttagggttaaaccggacgtaaacttaccgaacgttccggggtaccttacggttaacccgtacccgttacgtaaccgttacggggttacccggggttagggttacggtttccgggaccgggtaacgggtaacccgaacggtaccggtacgggtaacccgttaccgttacgggttccttaacggacccgtaacgggtccgtaccgggtccccccgtagggtaccctaacgtttcccgg

SEQ ID NO: 106119 - DNA, 570 bp, Homo sapiens
  misc_feature: GYAE6OF02IRKAR.12.3.A03.1.454.CMB.1.raw
  modified_base (177)..(177): a, c, t, g, unknown or other
  misc_feature (177)..(177): n is a, c, g, or t
  modified_base (395)..(395): a, c, t, g, unknown or other
  misc_feature (395)..(395): n is a, c, g, or t
  modified_base (433)..(433): a, c, t, g, unknown or other
  misc_feature (433)..(433): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctnagcgtctgggacccccgggcagacgggtcaccatttcctgttctggaacccactccaacatcggatataattctgtagactggtaccagcagcttccaggagccggtcccccccgatccctcacttcctttaaataaccaaatcaaggccggccctcgacggggtccctgacccgattcctctggctcaagtctcggcacctcagcctccgtggccancaggtcggctcagtctgagctgagctgattatactgtnctatcagtggcttgacctcccgtgacttcgggaccggtagttcggttcggcgggtaggacctaggtcgtaccggaccgtccgtaggtccaacggcccgaaggcctaacccgtcccccgtagggtacctccgtacccg

SEQ ID NO: 106120 - DNA, 583 bp, Homo sapiens
  misc_feature: GYAE6OF02HHFQH.12.3.A03.1.454.CMB.1.raw
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (421)..(421): a, c, t, g, unknown or other
  misc_feature (421)..(421): n is a, c, g, or t
tcagatacgacgtacacgaccggtgctcgatttagagagcgtcacagagaggaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccgatttcttgttctggaaccccactccaacatcggatataattctgtagactggtaccagcagctcccaggaaccggcccccaaactccctcatctatagtaataatcagccgaccctcgacggggtccctagaccgatttccnctcgggcctccaagtctggcacctcncgtcctccctgccatccagtcgggctccgatcgtgaggtatgggngtcgtgtagttaattacgtgtacgctaagcgagtgggtatgaacagaccgtgtaacgttcgggttccgttagtcgggcggtaacgggaccaggcgtacggaccggtacgtaggtccgaccgacccgtaggtccctccggcccccgttcggtcctacttcccg

SEQ ID NO: 106121 - DNA, 814 bp, Homo sapiens
  misc_feature: GYAE6OF02JYYTM.12.3.A03.1.454.CMB.1.raw
  modified_base (181)..(181): a, c, t, g, unknown or other
  misc_feature (181)..(181): n is a, c, g, or t
  modified_base (204)..(204): a, c, t, g, unknown or other
  misc_feature (204)..(204): n is a, c, g, or t
tcagatacgacgtacacgaccggtgctcgatttagagagcgtcacagagaggaagggggggggtagagaagacagggactcaggacaatctccagcatggccagcttccctctcctcctcacccctcctcactcactgtgcagggtcctgggcccagtctgtgctgactcagcccaccctnagcgtcgtcggggacccccgggnaggtaggtccacctagttttccttggtttacgtagggaacccctcctaccaaccattaccgggataattaatttccgagttacgacttacgggtaaccagtctaagtccttacggaggacggcccccggaccccccggtactcccgtactacttacttaaacttaaccatacgaaccgtccgcccgttaccggcggggtaccctcggtaacgtaccgtttctaccgtggtaccttacctaaggtccttcgggacctacccgttcgaccggtccccttcccgttcgggacctaaccgttacggtccgggtacgggtcctaccggtcgttacgtacggtaacgggagttcgggaaggtcgttaacggtaattttaccgtaagttcggtataccagtcgtaacgtcggtacgtccgtaccgacccgttacgtacgggttccggtaccggggtcggtttacggggtacccggtaggggtaaccgggaccggtacggtaacccggtttccggggaacccttaccgggttaccggtaccgtaacccggtaccccggaaacggtttcccggaaccccggttccccggtacccgttaccggtccccggttaaccccgg

SEQ ID NO: 106122 - DNA, 736 bp, Homo sapiens
  misc_feature: GYAE6OF02HKAJ4.12.3.A03.1.454.CMB.1.raw
tcagatacgacgtacacgaccggtgctcgatttagagagcgtcacagagaggaagggggggtagagaagacaggactcaggacaatctccagcatggccagcttccctctcctcctccaccctcctcactcactgtgcagggtcctgggcccagtctgtgctgactcacgcccacctcagcgtcgtcgggaccccggcaggagggtccactattttcttgttcctaggaacccactacaacattacggataattaattctagtagactggtaccagcagtcttccgaggacgtccccggacccccgactcctactacttactttaaacaaactaactaccgaacggcccggtacccctaccggtacggggtccctacggtaacccgtactttccgtcgtacgggtccttaccggtaaacgttccggtcggtacccaaccctttaacgacccggtaccccttcccgtacgggtaccctaagttaccggacggggttcggggtaccctccggtaacggtacctagggtaaccggagtacggacggtattagtaatttaacgtacgtgttcgactatcgacgtgggacttacggacctacgtcgacgttcggggtacggtagttcgggtaccggaggtaacggctaacggtcgtaccggtaaccgtccgtacggtacgaacccggtaccgaaccgggtcccgtacccgttccccctaacgggtccctaacccgttccgg

SEQ ID NO: 106123 - DNA, 763 bp, Homo sapiens
  misc_feature: GYAE6OF02F8CSJ.12.3.A03.1.454.CMB.1.raw
  modified_base (199)..(199): a, c, t, g, unknown or other
  misc_feature (199)..(199): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcagggtcctgggcccagtctgtgctgactcagccaccctcagcgtcgtcggggacccccggnacggagggtccaacctatttcttgttctcggaacccactaccaactatcggaattataatttctagtacgtactggtaccagcagtccttcgaaggacgccccggacccccgtactccctcgtaacttacctttaaataactaatcgacgtaccggtcccgtacggtacggggtccctacggtaccgtacttcgtcgtcgtcctaccgtaagtcgtacgtccacctcgacgtccctccgtcgtacctacgtccggtacggtccgggtacctaccggtacgtcgtacggaggtacgtacgggtacgtcgtacgttaacgttaacgttcggttgttacgtacgttacgtaccgtagggtcggttaccgtaccgaaccgtacccgttacggtacggttccggggtaaccggttcggtccgggttacggggaaccgggtaacgggtaccgtaaccggtccggttaaccggtaacccgggttacggtaacccgggtacctaccggaccccggtaacgggtccctaaccccggtccccgggttaacgtcccggtaaccgtttaccccggg

SEQ ID NO: 106124 - DNA, 924 bp, Homo sapiens
  misc_feature: GYAE6OF02FRU1E.12.3.A03.1.454.CMB.1.raw
  modified_base (112)..(112): a, c, t, g, unknown or other
  misc_feature (112)..(112): n is a, c, g, or t
  modified_base (910)..(910): a, c, t, g, unknown or other
  misc_feature (910)..(910): n is a, c, g, or t
tcagatacgacgtacacgaccggtgctcgatttagagagcgtcacaggaggagaaggggggggtagacgaagacaggactccaggacaatctccagcatggccagcttcccnctcctcctcaccctcctcactcactgtgcagggtcctgggcccagtctgtgctgctcagccaccctcagcgtcgtcggggacccccgggcaggacggggtccacccgtaattttccgttcggttaccgtcgggaaaccccacgttcccaaacctagttccggattacttaacgtttccgtagttaagtaccgttacggttaaccccaggaccgtacggtccgtttacccgaaggggtacggtcccccgggggacccccccccgtacgtcccccgtacctaacgtttacccgttttaaaacgtaaacgtaaacgttaccggtaacggggtcccgggtacccccgttacggtaaccggggggttccccttacgggtaacccggttacgtttaccctacggttacgggtacccctaacccgtaaacggtttcctacggggacctaacccgttacggaaccgtcccctttaccccggcggtaccacgttaccggtacgggtcgggtacctacccggtaagttaccggtacggtaacgggtacttaccgggaacggttccgttaacggttaatttaacgtttaaccggttggttaccggtacacgttaaccgtacgggtcgggtacccttacggtaaccctaccgtacggtccggttacggggtaccgggttaggttccgggtaccggggacgggtaccgggacccgtaaggtccgtaacgggttacccgttaaccggtacgggttacccgtaaccggacccgggtaacgtcccggtacccggtaccccggtacggttacccnccggtttaccccgg

SEQ ID NO: 106125 - DNA, 757 bp, Homo sapiens
  misc_feature: GYAE6OF02JJS9H.12.3.A03.1.454.CMB.1.raw
  modified_base (167)..(167): a, c, t, g, unknown or other
  misc_feature (167)..(167): n is a, c, g, or t
tcagatacgacgtacacgaccggtgctcgatttagagagcgtcacagaggagaagggggagtctccctcactgcccagctgggatctcagggcttctattttctgtcctccaccatcatggggtccaaccgccatcctcgccctcctcctggctgttctccaaaggngtctgtcgaccgaggtgcagctggtgcaggtctgaacgcgaaggaggtagaaagacggcccggggatctacgagacgactctcgtaggtaacgggtctaggactacgacctttcccacctacgtggactcggcgtggggtcgccggactacggactcgggaacccggggaagtccgtggacggtcgaggtacggggtattacgtcgtaacggttcccggtagtacgtttacggacttaacgagtaacgtacgaccgttaccgtacgtaacgttaccggaaacggtcccgtaacggttaccaccctattaccgtaccgtacggttaaccgaacgtaaccgttaccgtaacttaaccgaacccgtaacccggttaccctaaccgttacggtaaacggttacggggaacggtaccggtaccggttaacgggaaccggggcccggaaccgggaccacccggtacgtaacgttcgttaacgttaacttcgggtacgtacggaccgtacgtacgaacgtaacgttaccgtaacggaaacggtaagtacttacgttacgtttacttaccggttacgttacgttccgttacccttagg

SEQ ID NO: 106126 - DNA, 696 bp, Homo sapiens
  misc_feature: GYAE6OF02ID4W3.12.3.A03.1.454.CMB.1.raw
  modified_base (139)..(139): a, c, t, g, unknown or other
  misc_feature (139)..(139): n is a, c, g, or t
tcagatacgacgtacacgaccggtgctcgatttagagagcgtcacagagaggaaggggggggtagagaagacaggactcaggacaatctccagcatggccagcttccctctcctcctcaccctcctcactcactgtgcngggtcctcgggcccagtctgtgctgactcagcccaccctcagcgtcgtcgggcccccgggcacggacgggtcacctatttcttgttcgtacggaacccactaccaactaagtcggaactaattaattctagtacgactcggtacagcagtcttccgaggacgccggcccccgactcctcacttacgttaataacaatcgacgccgccctcgacgggtccctgtaccgtattctcgtcggtacctacgaacgtctacggaccgtacctccaacgttccgtaccgtcgacctacgtcgtacggtcgggcctccgaagtccgtaggacggtagtcggacgtcctagtaactttagtacgttgtacgtactacgtcgtaagttcggacttacgtaaccgtaaccgtcgggtaccgggttcgggtaccggttaacggttccgggtacggcgggtaacgggaacctacggtccgtaccggtacccggtaaccgttcggacctaccggacccgaacgggcccgtaaccccggttccccggtacggtaccgtacccgttccccgg

SEQ ID NO: 106127 - DNA, 508 bp, Homo sapiens
  misc_feature: GYAE6OF01DC4WL.26.59.F04.1.454.CMB.1.raw
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (320)..(320): a, c, t, g, unknown or other
  misc_feature (320)..(320): n is a, c, g, or t
tcagagactatactcacgaccggtgctcgatttagtacacacacttagggattgggggagtcagtctcagtcaggacacagcatggacatgagggtccccgctcagctcctggggctcctgctactctggctccgagctgccagatgtgacatccagatgacccagtctccttcatccctgtctgcatctgtcggagacagagtcaccatcacttgccgggnaagtcagacccttaccacctatttaaattgtatcacanagaccaggaagtccctaactcctgatctatgctgcatccaatttgcaaagtgggtccatnaaggttcagtgcagtggatctgggacatatttcagtctacagtatcagcagtctaacaactgaagtatttaggaacttatactgtacaacagagttcaactactattccgtgtacgttcggacgaagggaccaagggtacggaaagtaccaaacgaactggtaggactaggcaaccatctgtcttacg

SEQ ID NO: 106128 - DNA, 616 bp, Homo sapiens
  misc_feature: GYAE6OF02JPU7J.26.59.F04.1.454.CMB.1.raw
tcagagactatactcacgaccggtgctcgatttagtacacacacttagggattgggggagtcagtctcagtcaggacacagcatggacatgagggtcccgctcagctcctggggctcctgctactctggctccgagctgccagatgtgacatccagatgacccagtctccttcctcctgtctgcatctgtcggagacagagtcaccatcactgccgggcaagtcacgacccttaccacctatttaaattggtactacacagagaccagggaactcctaacctcctagatctatcgctgcatcctaattcgactaacgttcggggtacctagtacgtaaggttcgaggtggctaaggtggtaattccgtagggtaactacgttacgtttcgtaacgtcttactaaggttatacgacgtacgtacgtactaacgtaaccgtagtaaacgttactttacggtaactttacgtaacttacgtactaacgtgaacgtcctaactacttacgttccggtacggtacgttcggacgaacgggtacgaacgtaggaactaaccggaaacgtaacgtggtaacgcgtacgaccgtacctacgttcgtacgttacctacttacccg

SEQ ID NO: 106129 - DNA, 515 bp, Homo sapiens
  misc_feature: GYAE6OF01DFRZL.36.59.F04.1.454.CMB.1.raw
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
tcagtacgctgtctcacgaccggtgctcgatttagtacacacacttagggattggggggtccctgagactctcctgtgcagtctctggattaatctttagtgactatgccatgatctgggtccgccaggctccaggggaaggggctggagtgggtctcagcaattaatggtaggggtgattcaccacattacgcggactccgtgggggccgttcaccatcaccagagacaactccaggagcacgctatatctgcaaatgcacagcctgagagtcgaggacacggccgtgtattattgtgcgagagatcccaacggtgaccacattggtgcttttgattttttggccacgggacaatggtcaccgtctcttcagcctcaccagggccatccggtcttcccctggccgccctcgctccaggacgcaccctctgagacgcacaggccggcccgtcgggctggcctggtcacggactacttccagcagcgtactggcgcgggctggcaaggcncgntgn

SEQ ID NO: 106130 - DNA, 585 bp, Homo sapiens
  misc_feature: GYAE6OF01DRW04.36.59.F04.1.454.CMB.1.raw
  modified_base (211)..(211): a, c, t, g, unknown or other
  misc_feature (211)..(211): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
tcagtacgctgtctcacgaccggtgctcgatttagtacacacacttagggatcagggctgaacagagagaactcaccatggagtttgggctgagcgtgcgttttctgtggctgttttaaaaggtgtccagtgtgaggtgcaggtgtcggaatcgtggggggaggcttgggttcagccgtggggggtccctgagactctcctgtgcagtctntggattaatctttagtgactatgccatgatctgggccgcaggctccgagggaaggggctggagtgggtcctnagnaattaagnggtaggggtnattcaccanattacgcggactccggtgggggcgttcacatcaccaggacaacaacnccaagggacncacgtctaatatctagacaaaagtcacacagcctgagagcgaggacacgggccgtagtattatgtgacgaganacgtcccaaggtcgaaccactaagttggtagtcctttttggttagttttttcggaccgtacgggacgtaatacgggtcctaaccgtccttccttcacgcccttacccgaaccgaaccgggcccctaagtcccgggttccccc

SEQ ID NO: 106131 - DNA, 713 bp, Homo sapiens
  misc_feature: GYAE6OF01C6YAW.36.59.F04.1.454.CMB.1.raw
  modified_base (331)..(331): a, c, t, g, unknown or other
  misc_feature (331)..(331): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtggggggaggcttggttcagccgtggggggtccctgagactctcctgtgcagtctctggattaatctttagtgactatgccatgatcgtgggtccgccaggctccgaggggaagggctggagtgggtctcagcaattagtggtagggtgattcaccactattacgcggactccggngggggccgttcacatcaaccagagacaactccaggacgcacgctatatctagactaaatcgactaacgacgaccgttagaacggacggtacggaacgggaaccgaacccggggtaccggttaggtttaagtttagtttaggttacggtacggaaggtaacgtaacgtaccccgtaaacggggttaccgaacccgtaaccgtaacgtttacgggttacgtttcggtttttttaggtttacgttttttttacgggacccggttaacggggtaaccgtaaggttaccggttaccgtacccgtttccttccgtttaccgtaccgttaccccgtaccccgtaaccccggtaacgggtacccccgtacgttcccgggtttaccccccg

SEQ ID NO: 106132 - DNA, 542 bp, Homo sapiens
  misc_feature: GYAE6OF01EQHRY.36.59.F04.1.454.CMB.1.raw
  modified_base (250)..(250): a, c, t, g, unknown or other
  misc_feature (250)..(250): n is a, c, g, or t
  modified_base (377)..(377): a, c, t, g, unknown or other
  misc_feature (377)..(377): n is a, c, g, or t
tcagtacgctgtctcacgaccggtgctcgattttagtacacacacttagggatcagggctgaacagagagaactcaccatggagtttgggctgagcgtgtgtttctaggtggctagttttaaaaggtgtccagtgtgaggtgcaggtgtcggaatctggggggaggcttggttcagcctgggggggtccctgagactctcctgtgcagtctctggattaatctttagtgactatgccatgatctgggccnccaggctccagggaaggggctggagtgggtctcagcaattaatgggtaggggtgattcacacattacgcggactccggtgggggccgttcaccatcaccagagacaactcaggagcacgctatatcngcaaatgcacagcctgagagtcgagacacggcgtgtatattgtgcgagagactccaacggtgaccacaagttggtgttcgttttgtagtttttttcggcgtacggactaagtggtctaccgtcttcttcacgtccgtccaccgaacggccctagtcgttcccccg

SEQ ID NO: 106133 - DNA, 722 bp, Homo sapiens
  misc_feature: GYAE6OF01EW06Z.36.59.F04.1.454.CMB.1.raw
  modified_base (122)..(122): a, c, t, g, unknown or other
  misc_feature (122)..(122): n is a, c, g, or t
  modified_base (124)..(126): a, c, t, g, unknown or other
  misc_feature (124)..(126): n is a, c, g, or t
  modified_base (140)..(140): a, c, t, g, unknown or other
  misc_feature (140)..(140): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
tcagtacgctgtctcacgaccggtgctcgatttagtacacacacttagggatcagggctgaacagagagaactcaccatggagtttgggctgagcggcgtggttctaggcgctatttaaggncnnngagtgcagtgcgantgggagctgtcagcgtggggcctgagctctctgngcntctgtgtatatgttagtgtatatcnctatagtgtcgtcggtcgcgacgacgtacggaggaggtcgtggtaggtcggtcgtacgacgtacgtaagttaggtaggtaggtagtacgtacgtacgtacgtacgtacgtacggtaccggtcgggtcgggtcgtacgtacgtacgtacgacgacgacgacgtacgtacgacgacgacgacgtactacgtacgtacgtacgtaacgtaacgtacgtacgtacgtacgtacgtacggtacggtaacggtacgggtaaccggtaacggtaccggtacggttacgttaacgttacgttacggtacggtacggtaacggtaacgtaaccgtaaccggtaaccggtaaccgtaaccgtacggttacggtttacggtttacgtttacggttttacggttttacggtttacggtaacggtaaccggtacggtacgttaccggtaccgttaccgttaccgttaccgtaccgtaccgtacccgtacccgtaaccggtaacccgtacccgttacccgttacccggtacccg

SEQ ID NO: 106134 - DNA, 604 bp, Homo sapiens
  misc_feature: GYAE6OF01B8BPA.36.59.F04.1.454.CMB.1.raw
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
tcagtacgctgtctcacgaccggtgctcgatttagtacacacacttagggatcagggcttaacagagagaactcaccatggagtttgggctgagcgtgtcgttttcttaggtggctagtttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccgagggaaggggctggagtgggtctcagcaattaatggtaggggtgattcaccacattacgcggactccggtgggggccgttcaccatcaccagagacactccagancacgctatatctgacaaatgcacancctagagagtacggagacgacggtccgtagtattagttgtgcgtagagactcccgaacggtcgaccactacgttgtcgttcgttttgttagttttttcggccgttacgggactaagttcggtaccgtacccggttcttcccgttcgacgtccccttacccaacccgtaaccgggtacccctaacgttcccggttccccgtttcccccccggg

SEQ ID NO: 106135 - DNA, 616 bp, Homo sapiens
  misc_feature: GYAE6OF01CUTHJ.36.59.F04.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
tcagtacgctgtctcacgaccggtgctcgatttagtacacacacttagggatcagggctgaacagagagaactcaccatggagtttgggctgagcgtggtctttttctggtggctagttttaaaaggtgtccagtgtgaggtgcaggtgtcggaatcgtggggggaggcttgggttcagccgtggggggtccctgagactctcctgtgcagtctntggatttaatctttagtgactatgcatgatctgggtccgcaggcnccgagggaagggctggagtgggtctnagntaaatagtggtaggggtnatcacacattacgcggactccggngggggccttnacatcaccagagactaacncaggancagctaatatcngacaaagngacacagccagagagtcgagacgacggcgtntattatgtgacgagagacgtcccgaacggtcgaaccacgtagttggttagttcgttttagtttagtttttttcgggaccgtaccgggtaacgtaaacggttacgggtccctaacccggttcttcccgtttaccgaccggtccccttaaccccgaaccccggaaacggggtccccctaaggttccccggtttaccccccg

SEQ ID NO: 106136 - DNA, 611 bp, Homo sapiens
  misc_feature: GYAE6OF01B5FPU.36.59.F04.1.454.CMB.1.raw
tcagtacgctgtctcacgaccggtgctcgatttagtacacacacttagggatcagggctgaacagagagaactcaccatggagtttgggctgagcgtgcgtttctaggtggctagttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccgagggaagggctggagtgggtctcagctaattaagtgggtaggggtgatttcaccatattacgcggactccggtgggggccgtttcaccgatcaccagacgacaactccgaggacgcacgctatatcgtagactaaaatgaccaacgacgccctagaagacggtacggaaggaccgaacggccgttagttattattggtcgacgaagacgataccccgtaacggtcgaccactagtttaggtgttacgttttgttagttttttcggccgtacgggtactaagtcggtacgtacccgttccttcgtccgtacgtcccctaccaacccggaccggcccctagtccggttacccccg

SEQ ID NO: 106137 - DNA, 816 bp, Homo sapiens
  misc_feature: GYAE6OF01C5E1I.36.59.F04.1.454.CMB.1.raw
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
tcagtacgctgtctcacgaccggtgctcgatttagtacacacacttagggatcagggctgaacagagagaactcaccatggagtttgggctgagctggcttttcttgtggctgtttttaaaaggtgtccagtgtgaggtgcaggtgtcggaatcgtgggggaggcttggttcagccgtggggggtccctgagactctcctgtgcagtctctggattaattctttagtgactatgccatgatctgggtccncaggctcgagggagggctggagtgggtctcagctaaattaagtggggtaggggtntattccaaccactagtttaccggccgggtaccgttccggggtcggggggtccccgtttacgaacctactaccgaacccgaaggaacgaaccgaaaccgttcccgaagggtaccgccgaacgtctaagtaactcgtaaggacctaaaagtcgaccaacacgtcccgtaggaacggtacggtaccgggaacggaccggtaaccgggtacccggttaggtttaacgtttagttacgggtacggacggtaacggacggtaaccgtaccccgtaaacggggttaccgaacccgtaaccgttacggtttacgggttacgttttaccggttttttacggttttacggtttttttaccgggacccggttaaccggggtaaccgttaaccggtttaccgggttacccgttaccccggtttccgtttcccgttacccgtaacccgttcccccgttaaccccggtaaaccccggtaacccggggtacccccgttaaccggttcccccgggtttaccccccgg

SEQ ID NO: 106138 - DNA, 608 bp, Homo sapiens
  misc_feature: GYAE6OF01CZKM4.36.59.F04.1.454.CMB.1.raw
  modified_base (234)..(234): a, c, t, g, unknown or other
  misc_feature (234)..(234): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
  modified_base (381)..(381): a, c, t, g, unknown or other
  misc_feature (381)..(381): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagcgtggtcgttttctaggtggcttagttttaaaaggtgtccagtgtgaggtgcaggtgtcggaatgtggggagcttggttcngccgtgggggtcctgagctctcctgtgcagtctntggattaatntttaagtgactatgaccatgatcgttcgggtcccnccgaggccaccggaggggaacgggcgttggaggtgggtctacgagactaagttaagtgggtaagggtnattacacacgtattaacggcgtaccgtcgggtcggggtccgttacacacgtcaccgaaggacaacaactcgaacgganactacgactatactcagaccaaancgacanacgttccagacgacgtcgacggaacgccggtgttatacgttagttcggatacggaagacgtaaccgttacccccggaaagggtcaaacccctagtaacggtttgggtccgtttttacgg

SEQ ID NO: 106139 - DNA, 583 bp, Homo sapiens
  misc_feature: GYAE6OF01D76ZO.36.59.F04.1.454.CMB.1.raw
  modified_base (311)..(311): a, c, t, g, unknown or other
  misc_feature (311)..(311): n is a, c, g, or t
  modified_base (359)..(359): a, c, t, g, unknown or other
  misc_feature (359)..(359): n is a, c, g, or t
tcagtacgctgtctcacgaccggtgctcgatttagtacacacacttagggatcagggctgaacagagagaactcaccatggagtttgggctgagctggctttttcttgtggcttgttttaaaaggtgtccagtgtgaggtgcagggtgtcggaatcgtggggggaggcttggttcagccgtggggggtccctgagactctcctgtgcagtctctggattaatctttagtgactatgccatgatcgtgggtccgccgaggctccgaggggaagggctggagtgggtctcgagctaattaagtgggtagggtntattcaccatacgttacggcggtactccgggtgggggtccgttcaccntcaccgagacgacaactcaggacgcacgctatactctgactaaatcgacacacgcctagagagtacggacggaccgacggtcgtagttagttagttgtgacgagacgtactacccgtaacggtcgaaccacgtacgttggtgttcttttgttagtttttcggccgtacggtacgtagtcgtcgtaccgtctctcacgcctccaccgacggcctgtccggtcccg

SEQ ID NO: 106140 - DNA, 603 bp, Homo sapiens
  misc_feature: GYAE6OF01B0Q2J.36.59.F04.1.454.CMB.1.raw
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (459)..(459): a, c, t, g, unknown or other
  misc_feature (459)..(459): n is a, c, g, or t
tcagtacgctgtctcacgaccggtgctcgatttagtacacacacttagggatcgagggctgaacagagagaactcaccatggagtttgggctgagctggctttttcttgtggcttgtttttaaaaggtgtccagtgtgaggtgcaggtgtcggaatcgtgggggaggcttggttcagccgtggggggtccctgagactctcctgtgcagtctctggattaatctttagtgactatgccatgatcgtgggtccgccaggctccgagggaagggctggagtgggtctcagcaattaagtgggtaggggtagatttccgaccacgtattacggcggtactccgggtcggggggtccgttcaccgatcaaccgagacgacaactcgaggancacgctaatntcctagacaaatgacacgagccgtagagagtacgaggacgacggtccgtgttattattgtgngagagactacccgacgtacgacctacagtttcgtgttcgttttgttagtttttcggaccgtaacggtactaacgtcggtccgtaccgttccttccgttcgaccgtcccgtcccaccgtaacggccctacgtcccggttcccccg

SEQ ID NO: 106141 - DNA, 777 bp, Homo sapiens
  misc_feature: GYAE6OF01DDYOR.36.59.F04.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (172)..(172): a, c, t, g, unknown or other
  misc_feature (172)..(172): n is a, c, g, or t
tcagtacgctgtctcacgaccggtgctcgatttagtacacacacttagggatcagggctgaacagagagaactcaccatggagtttgggctgagcggtgtgttctaggcggctagtttaaaggtgtcagtgtgagtgcagtgcgatctgggggngtgtgtngcgtcggtcgngagctctctgtgcgtcgtcgtcgtagtattattagttagtagtactagtcgacgtagtcgtacgtcgtcggtccgcgacggtccgtacggagggagggtacggtggtcggtcgtcgtacgtacgtagtagttaggtagggtaggtagtactactaccgtacgtacgtacggtaccggtaccggtccgggtccgggtaccgtaccgacgtacgtacgacgacgaacgaacgaccgacgacgacgacgtacgtactactacgtacgtacgtaacgtaacgtacgtacgacgacgtacggtacggtaacgtacggtacgggtaaccggtaaccggtaccgggtacggtttacgttacgttacggttacggtacggtacggtaacggtaaccggtaaccggtaaccggtaacggtaaccgtaaccgtaacggttacggtttacggtttacggttttacggttttacggttttacggtttaccggttaccggtacggttaacgttacggttaccggttaccgttacccgttaccgttccgttacccgtaccgtacccgtaacccgtaacccggtaacccggtacccggttacccgttccccggttccccg

SEQ ID NO: 106142 - DNA, 606 bp, Homo sapiens
  misc_feature: GYAE6OF01AKC5Q.36.59.F04.1.454.CMB.1.raw
  modified_base (100)..(100): a, c, t, g, unknown or other
  misc_feature (100)..(100): n is a, c, g, or t
  modified_base (127)..(127): a, c, t, g, unknown or other
  misc_feature (127)..(127): n is a, c, g, or t
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagtacgctgtctcacgaccggtgctcgatttagtacacacacttagggatcagggctgaacagagagaactcaccatggagtttgggctgagcggtgngtttctaggtggctagttttaaaaggngtcagtgtgaggtgcaggtgtcggaatcgtgggggaggcttggttcagccgtggggggtccctgagactctcctgtgcagtctctggattaatctttagtgactatgccatgatcgtgggtccgcaggctccgagggaagggctggagtggtctcaggctaaagttaagnggggttaaggggtgaatttccgaccactagttaccggcggtaaccgtccgggtggggggcccgtttcaacgntcaccaggagaccaacncgaagggcncacggtcaatntctggacaaatcgacacgatccagagagcgacggacacgggccttagtagtttagtggtgcgaggagaccgacctacgggacaccgacgtagttgtcgtttcgttttgtttagtttttccgggacgtacgggtacctagttcgtaccgtccgttctcgttcaccgttccctacacccgaggaccctgtcccggttccccg

SEQ ID NO: 106143 - DNA, 724 bp, Homo sapiens
  misc_feature: GYAE6OF01BE1AI.36.59.F04.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagtacgctgtctcacgaccggtgctcgatttagtacacacacttagggatcagggctgaacagagagaactcaccatggagtttgggctgagcgtgtcgttttctaggtggcttagttttaaaggtgtcagtgtgaggtgcaggtgtcggaatcgtgggggagtcgttggttcagccgtgggggtccctgagactctctgtgctgtctgtggtattattgtttagngacttncgcatgctcgtcggccgaccnggcctcgaagggtaggctggagtggtcnagntaaatgtgggtaggtctagttccacctagacgttcggccgtacgtccgggtggggccttcacgtnaccganaggacaacacacgagacgctacgntacttancgagacaaagtcgcaccgagtccgaggagtcggaccgaggaccgtacgggtaccgtagtttagttacgtggttgacggtaagtacgtaacgtccccggtaaggtcgtaacccgttacgtacgttcgggttttaccgttttggtttttccgtttttaacgggtttttccggacccggtttaaaaccggggtaaaccgtttccggggttaaaccgtttcccgtttaaccccgggttccctttaccgggttttccccacccgggtttaccccccttaaccggggaacccttacccgggggacccctttaaccggggtttcccccccgttccccccgggg

SEQ ID NO: 106144 - DNA, 575 bp, Homo sapiens
  misc_feature: GYAE6OF01EHX2F.36.59.F04.1.454.CMB.1.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
tcagtacgctgtctcacgaccggtgctcgatttagtacacacacttagggatcagggctgaacagagagaactcaccatggagtttgggctgagctggcttttcttgtggctgttttaaaaggtgtccagtgtgaggtgcaggtgtcggaatcgtggggggaggcttgggttcagcctggggggtccctgagactctcctgtgcagtctctggattaatctttagtgactatgccatgatctgggtccgcaggctccgagggaagggctggagtgggtctcagcaattaagtgggtaggggtnattcaccactattacggcggactccgggtgggggccgttcaccatcaccagagaccaactccgaggacncacgctatatctgacaaatgacacacgcctgagagtacggaggacgacggccgtgtagttattgtgcgagagtactccgaacggtcgaccactagttggttgttcgttttgttagttttttcggaccgtacgggtactaagttcgtccgtaccgttcttccttcgactccctaccaccgaacggccctacgtccggttccccg

SEQ ID NO: 106145 - DNA, 544 bp, Homo sapiens
  misc_feature: GYAE6OF01DJSYM.36.59.F04.1.454.CMB.1.raw
  modified_base (369)..(369): a, c, t, g, unknown or other
  misc_feature (369)..(369): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
tcagtacgctgtctcacgaccggtgctcgatttagtacacacacttagggatcagggctgaacagagagaactcaccatggagtttgggctgagctggctttttcttgtggctgtttttaaaaggtgtccagtgtgaggtgcaggtgtcggaatctggggggaggcttggttcagcctggggggtccctgagactctcctgtgcagtctctggattaatctttagtgactatgccatgatctgggtccgccaggctccgagggaagggctggagtggtctcagcaattaatggtagggtgattcacacattacggcgacgtccggtagggggccgttcaccatcaaccagagacaaactccgaaggacnccacgctatatctagcaaatgacacagctgagagtcgaggacgacggccgtgtattattgngcgagagactaccgaacggtcgacactagttggtntctttgttatttttggccgtacggacagtcggtctacgtctcttcgacgcctccaaccgacggcccagttccgtccccg

SEQ ID NO: 106146 - DNA, 584 bp, Homo sapiens
  misc_feature: GYAE6OF01CTV5V.36.59.F04.1.454.CMB.1.raw
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgcaggctccgagggagggctggagtggtctcgagcaaagttaatgggtaggggtnagtttcaaccacagtttacgcggtacgtccgggtgggggcccgtttcaccatcaccagacgacaactccgaggacgcaacgtctatatcgtancaaatgacacagcctgagagtacgaggacacggcgtagtattagtgtgacgagagactacccgaacggtcaccacgtagttggtcgttcgttttgttagtttttcggacccgtaacgggactaagtcggtaccgtaccgttcttccttcgacgtccctacccaaccgtacggcccagttccggttccccg

SEQ ID NO: 106147 - DNA, 767 bp, Homo sapiens
  misc_feature: GYAE6OF01CCMZF.36.59.F04.1.454.CMB.1.raw
  modified_base (127)..(127): a, c, t, g, unknown or other
  misc_feature (127)..(127): n is a, c, g, or t
  modified_base (129)..(129): a, c, t, g, unknown or other
  misc_feature (129)..(129): n is a, c, g, or t
  modified_base (138)..(139): a, c, t, g, unknown or other
  misc_feature (138)..(139): n is a, c, g, or t
  modified_base (143)..(143): a, c, t, g, unknown or other
  misc_feature (143)..(143): n is a, c, g, or t
  modified_base (148)..(148): a, c, t, g, unknown or other
  misc_feature (148)..(148): n is a, c, g, or t
tcagtacgctgtctcacgaccggtgctcgatttagtacacacacttagggatcagggctgaacagagagaactcaccatggagtttgggctgagcggtcgtggttctaaggcggctagtttaaaggncngtgtgagtnngtgngatgngggagctgtcagtcgtggggtcctgagctctcgtgtgcgacgtctcgtgtattagttagttagtagtactagtcgtactagtgtagtcgtcggtccgaccgacggtccgtaccggacggggacgggtcggtcgggtaggtcggtcgtacgtacgtacgtaagttaaggtagggtagggtacgtacgtaccgtacctaccgtacgtacggtaccggtacccggtccggggtaccggggtacccggttacccgtaccgtacgtaccgaccgacgaaccgtaaccgtaaccgtacgtaacggaccggtaccgtaccgtacgtaacgtacgtacgtacgtaacgtaacgtacgaccgtaaccgtaccgtacgtacggtacggtacggtacgggtaccggaaccggtaccggtacgttacgttagttaggttggtacggtacggtacgtacgtaccgtaccggtacggtaccgtaccgtacgtacggttcgttcgtttcgtttacgtttacgtttacggtaccggtacggtacgtacgttacgtaccgttaccgttaccgttccgtcccgtacccgtacccgtacccgtacccgtacccggtacccgtcccgtcccggttcccg

SEQ ID NO: 106148 - DNA, 777 bp, Homo sapiens
  misc_feature: GYAE6OF01EFJY0.36.59.F04.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (348)..(348): a, c, t, g, unknown or other
  misc_feature (348)..(348): n is a, c, g, or t
tcagtacgctgtctcacgaccggtgctcgatttagtacacacacttagggatcagggctgaacagagagaactcaccatggagtttgggctgagcggtgtcgtttctaggtcggctagttttaaaaggtgtcagtgtgaggtgcaggtgtcggaatcgtggggggagcgttggttcagccgtggggggtccctgagctctctgtgcngtctntggtattaattctttagtgactatgcctatgatcgttcgggtcccgccgaggccgtaccggaagggggaaccggggtctaggggaggttcgggtctacggaagtactaaagtttaaaggtggggttacgggggttntaactttaccgaacctaacgttacgttaccgggaccgggtaccggttccgggggttccgggggggtcccgtttaccgaacctactaccgaaccgtaacggaacgaacccttaaccgtccggaaagggctaccgaccgtattaactctacgtacgaactaaagtcgaactacgacgtcgaggtacgacgtacgggaacgaccggaccggtacgttagttaagtttcgtaggacgacgtagacgtacctaccggacggtaccaaccgtagttagtttggttactttacgtttttagttttacggttttaccgggaacccggtagggtaaaccttaggttacccggttcctaaccgtttcgtttaccgtccgtaccccgtccctacccggaaacggttaccccggaccgtttccgttccccggttacccccg

SEQ ID NO: 106149 - DNA, 653 bp, Homo sapiens
  misc_feature: GYAE6OF01CR34N.36.59.F04.1.454.CMB.1.raw
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagctggtctttttcttgtggctagttttaaaaggtgtccagtgtgaggtgcaggtgtcggaatcgtgggggagcttggttcagccgtgggggtccctgagactctcctgtgcagtctctggtattaattctttagtgactatgccatgatcgtcggtccgccaggcctccgaaggggagggcgtggaggtgggctcgagactaagttaagtggggtacgggtagtattaccgaaccacgtaagttaccggacggtaccgtccgggtcgggggtcccggttacaccgtatccgaacccgagaacaaccaaccgtccaagggaccncaaccggtctaactntaccgttagaactaaacgtgaccgtaacacggcccttagggaacgacggttaccgaacgggacctacccgggtcggtttagtaacgtttagtcggtacggtacgaaggtacgacccgtaaccccgaggtaccgaaaccctgtaacttggggtaccgttttacg

SEQ ID NO: 106150 - DNA, 551 bp, Homo sapiens
  misc_feature: GYAE6OF01BXWR4.36.59.F04.1.454.CMB.1.raw
  modified_base (192)..(192): a, c, t, g, unknown or other
  misc_feature (192)..(192): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
tcagtacgctgtctcacgaccggtgctcgatttagtacacacacttagggattggggagctctgagagaggagcccagcccgtgggtattttcgaggttgtttttctagttttggtgatcgagggctagaacagagagaactcaccatggagtttgggctgagcgtgtcgtttctagcgctagtttaaaggntcagtgtgagtgcagtgtggatcgtggggagcgttggttcagcgtcggggtcctagagctctcngtgcngtctgtgattaatgttagtgaatgngcatgtctnttggaccncgacgtcgacggaggagtcgtggagtcgacngacgtataagttaggnggttacggatactacgactacgacgtacggcgtaccggtcgggtacgggtcctacacactacgaacgagacgaactacgacgaggacactacgntaatntcacgacagacncaacncgttcaggacgacgacgaaggaccgacgttatagttattacgtaggcgagagacgacgtacgacgtacgacactagtgttgttcg

SEQ ID NO: 106151 - DNA, 606 bp, Homo sapiens
  misc_feature: GYAE6OF01AKYHG.36.59.F04.1.454.CMB.1.raw
  modified_base (352)..(352): a, c, t, g, unknown or other
  misc_feature (352)..(352): n is a, c, g, or t
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagctggctttttcttgtggctgttttaaaaggtgtccagtgtgaggtgcaggtgtcggaatcgtggggggaggctttgggttcaggccgtggggggtccctggaggactctcctgtgcagtctctggtattaatctttagtgactatgccatgatcgtgggtcccgccaggcctccgaggggagggctgggagtgggtctnagctaagttaagtggggtagggtgattcaccatagttacgcggtacgtccgggtcgggggccggttcaccactccaccgagacgaaccaacgtccgaggacgccacgacttatactcagactaaatccgacacacgcctaggaacgacggtacgaacgggaccgaccgggtccgttagttacttaagtggtacggacggaaggtacgaccgtacccgaacgggtacaacccgtatagtttgggttgttttacgg

SEQ ID NO: 106152 - DNA, 775 bp, Homo sapiens
  misc_feature: GYAE6OF01C7PRH.36.59.F04.1.454.CMB.1.raw
  modified_base (254)..(254): a, c, t, g, unknown or other
  misc_feature (254)..(254): n is a, c, g, or t
tcagtacgctgtctcacgaccggtgctcgatttagtacacacacttagggatcagggctgaacagagagaactcaccatggagtttgggctgagctggtctttttcttgtggctagtttttaaaaggtgtccagtgtgaggtgcaggtgtcggaatcgtgggggagtcttggttcagccgtgggggtccctgagactctcctgtgcagcctctcggacttccccttgagtgactactggatgcacgtgggtccnccaagcctcggagggacgggcgtggtgtcgggtctcgtacgttattagtagtgtagtgggtacttacaacgtaacttaagtggtggacgtccggtagggacgggtcccgtaattccgacctactccgtaccgaagaacgaacgaaccgaaccgaaacgtaaccacgacttagtactcgtacgaactaaataacgaacgtagttacgtaggaacggaccgtaccggaagggaacccgtacgggtcgttaggttagttttaacgtttagtttaggttaccgttaccgtttaaaccgggtttttacgggtaacgttttaaccgggtaccggtaaccggtaccggacggtaacgacgggttacggggacccgtaacggggtaccccgtcggtaccccgtaccgtcccgttacccaccgtacccggtcccctaacccggtaacccggtaacccgggtaccccttacccggtttacccccgggtttcccccttccccccgggtcggtcccccgtccccggtacccgg

SEQ ID NO: 106153 - DNA, 817 bp, Homo sapiens
  misc_feature: GYAE6OF01DQJGL.36.59.F04.1.454.CMB.1.raw
  modified_base (258)..(258): a, c, t, g, unknown or other
  misc_feature (258)..(258): n is a, c, g, or t
  modified_base (332)..(332): a, c, t, g, unknown or other
  misc_feature (332)..(332): n is a, c, g, or t
tcagtacgctgtctcacgaccggtgctcgatttagtacacacacttagggatcagggctgaacagagagaactcaccatggagtttgggctgagctggctttttcttgtggcttgtttttaaaaggtgtccagtgtggaggtgcaggtgtcggaatcgtgggggagcttggttcagccgtgggggtccctgagctctctgtgcagtctcgtggtattaacttctttagtgtactatcgcctatgatcgtcgggtcccncgaggctaccggaggggaacgggtctagggagtgtacgttctcgagacttaaagtttaaggtggggtaagggtntacttaccaacctacgtagttaccggaccggttaccgttccgggggtcggggggtacccttaccaaccgtagacccgtaacgaaggacgaacctaaaccgtccggaaggacgacctaaccggtacttaattacgtaccgtagaaacgttaaacgtcgaaccaaccgacgtaccgtagggtaacggtaacgggtacggaaccgggtaccggtaaccgggttaccggtttaagttaacgttttacggttggtaccggtaacggtaacgtaacgtacccgtaacccgggtaacggtaacccgtaaccgtaacggtttaggtttcgggtttcgttttacgttttttacgggttttacggttttttccgggaaccggtaaaccggttagtaaccggtttcggtaccccttaccggttccgttaccgttaccgacccgttaccctaaccccgaacccggtaacccgggtacccttaccggtttccccccgg

SEQ ID NO: 106154 - DNA, 636 bp, Homo sapiens
  misc_feature: GYAE6OF01EGRKG.36.59.F04.1.454.CMB.1.raw
  modified_base (125)..(125): a, c, t, g, unknown or other
  misc_feature (125)..(125): n is a, c, g, or t
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (594)..(594): a, c, t, g, unknown or other
  misc_feature (594)..(594): n is a, c, g, or t
  modified_base (606)..(606): a, c, t, g, unknown or other
  misc_feature (606)..(606): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
tcagtacgctgtctcacgaccggtgctcgatttagtacacacacttagggattggggggtccctgagactctcctgtgcagtctctggattaatctttagtgactatgccatgatcgtgggtccnccaggctccgaggggaagggctggagtgggtctcagcaattagtgggtagggtnattcaccanattacgcgactccgggtgggggccgttcaccatcaccagacgacaactccgaggacgcaacgctatatctgacaaatgcacacgcctagagaggtacgaggacgacggccgtagttattgttgtggacgagagacgtacccgaacggtcgaaccactagtttggtgttcgttttgtttagttttttcggccgtaacgggactagtcggtcctaccgttctctttacacgtcccctaccgaccgaacgggccctacgttcccggttaccccttccccgtcggcccgtccccgtcgtccgtcccgaggccaccgtacccgtcgacgacgccacgcggcccggtccgtcggccgtacgtccgtacggtacgaacgtacctaccgttacgacgtaccgaggtccgtacgnggacggtccggnggtacggacggtacggccgagngtagngcg

SEQ ID NO: 106155 - DNA, 786 bp, Homo sapiens
  misc_feature: GYAE6OF01AQZHD.36.59.F04.1.454.CMB.1.raw
  modified_base (494)..(494): a, c, t, g, unknown or other
  misc_feature (494)..(494): n is a, c, g, or t
tcagtacgctgtctcacgaccggtgctcgatttagtacacacacttaggatcagggctgaacagagagaactcaccatggagtttgggctgagctggctttttcttgtggcttgttttaaaaggtgtccagtgtgaggtgcaggtgtcggaatcgtgggggagcttggttcagccgtgggggtccctgagactctcctgtgcagtctcgtggtattaatcgtttagtgactagtgcctatcgatcgtgggtccgccacggtctccggaaggggaacggggcgttaggaggtcgggtctcgagacgtaaagtttaacgtggggtaacggggttcgtaacgtttccgaacctaacgtacgttaccggaccggtacgttccgggtcggggggtccgttaccaaccgtcgtaccacgaacgacgtaaccaaccgtccgaaggacggtacgacgtaccgttaatacgttacgtacgtaaccgtaaatcgaaccgtaacncgtaccgtaggaacgtacgtacgggaacggacgacgggtaccgttattaacgtttacgttacgtgtacggacgaacggtaacgtaccccgaacggtacccgaacctacgtaacggttttcgggttacgtttacgtttttacggttttacgttttaccggtaccggaaccggttacgtaaacggtttcggtaccctttaaccggttcccttaccgtttaccgtaaaccggtccccttaccccggtaaacccgtaacccgggaaccccgtttcgttaccccggggtttcccccc

SEQ ID NO: 106156 - DNA, 736 bp, Homo sapiens
  misc_feature: GYAE6OF01CAE2X.36.59.F04.1.454.CMB.1.raw
  modified_base (201)..(201): a, c, t, g, unknown or other
  misc_feature (201)..(201): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtgggggagcttggttcagccgtgggggtccctgagactctcctgtncagtctctaggattaagtcttttaggtgactatgcctatgatcgtgggtcccgaccgaggtcctaccggaggggtacggggtcgttgggaggtcgggtctacgagtactaaatttagtgggtaggggtatacttccgaaccaacgtacgtttaccggccggtaaccggttccggggtacggggggtccccggtttcaaccccgtatacccgaaccgaggaaccggacctaaccgtccgaaacgggacaccgaacggtaccttaagttaacgttacgtacgaactaaacgtcgaccaacgacgtcctaggacggacggtacggacggtaccgtacggtccgttagttagttagtttacggcggtagaggacgacgttacccgaacgggtcgaacctacgtagttcggtacttacgtttttaggtttacgttttcggaccggtacgggtaactacggttaccgttccgtaaccgttccgttcccttacgccgtacccctaccgaacccgacggccctaccggtcccggttacccccg

SEQ ID NO: 106157 - DNA, 670 bp, Homo sapiens
  misc_feature: GYAE6OF01A1IPZ.36.59.F04.1.454.CMB.1.raw
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggagcttggttcagccgtgggggtccctgagactctcctgtgcagtctctggattaatctttagtgactatgccatgattcgtcggtccgccgtagctccggaaggggtaacgggctgggagtcgggtctnagctaattagtgggtaggggtntaacttcacctacacgtttaccggcggtaccgttccggggtagggggtcccgttacaccatccaccgagacgtaacacgtccgagacgcacgctanattcngactaaatcgacaacacgcctagacgacgtacggaacggaccgtaccggaccggttagttagtttacgttggttacgcggtaagacgtacgtacccgaacggtacgaaccctagtacgtttggttcgtttagttttacggtttagtttttcggaccgtaacggtacgtaagttcggtaccgtaccgttaccgttcttaccgtaccgtacccgtacccgtaacccggtaccggtcccgtaccgttacccggttcccccg

SEQ ID NO: 106158 - DNA, 579 bp, Homo sapiens
  misc_feature: GYAE6OF01CEE72.36.59.F04.1.454.CMB.1.raw
  modified_base (188)..(188): a, c, t, g, unknown or other
  misc_feature (188)..(188): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (395)..(395): a, c, t, g, unknown or other
  misc_feature (395)..(395): n is a, c, g, or t
tcagtacgctgtctcacgaccggtgctcgatttagtacacacacttagggattgggagctctgagagaggagcccagccctgggattttcaggttgtttttcattttggtgatcgagggctgaacagagagaactcaccatggagtttgggctgagcggtgtgtttcgtaggcgtctagtttaaaggngtcagtgtgagtgcagtgacgatgtagggcgnttgtcagccgtggggtcctagngtctcgtctgtgcagtntntgtattactnttgtcgatagctccgagttcagtcgtcggccaccaggttcnccggaggaggngngtgtgcgtgaganataagtggtaggtgtgttcacacaacgtcgcgcgttcggtcgggccggttcaccgcncgacacgacgaacacgacgacgacgacacgtcctactaattcctacgtaacgtactacgacgacgacgtacgacgtacgtacgtacggacggacgtacggtacgttagttagttagtacggtcgtacgacggtacgtaccgtaccgtaccgtaccgtaccgtacgtacgttcgttacgtttacg

SEQ ID NO: 106159 - DNA, 752 bp, Homo sapiens
  misc_feature: GYAE6OF01C5UQI.36.59.F04.1.454.CMB.1.raw
  modified_base (333)..(333): a, c, t, g, unknown or other
  misc_feature (333)..(333): n is a, c, g, or t
tcagtacgctgtctcacgaccggtgctcgatttagtacacacacttagggatcagggctgaacagagagaactcaccatggagtttgggctgagctggtctttttcttgtggcttagttttaaaaggtgtccagtgtgaggtgcaggtgtcggaatcgtgggggagcttggtcagccgtcgggggtccctgagtactctcctgtgcagtctctggtattaattctttagtgacttatcgcctatgagtccgtcgggtcccgcgacggccgtaccggaaggggaggggctgggacggtggtcctagagtactaaagttaaggtggggtagggtntacttccaacactagttaccggcggtaccggtccggggtcggggggtacccgttcaacctactaccgaacccgtaggaaaccgacctaaacccgtacccggaagggaaccgaccgtaacggtaccttaataacgtcgtagtaactaaatcgactaccgacgtaaccgtaggaacggtacggtaccgggacggtaacccggtacgggtacgtacgtttaagttagttcggtagtacgacgacgtaaccgtacccgtaaggtaccgaacctacgtagtttcggttagttttcgtttttagtttacggtttttacgacccggttaaggacgttaacgtcggttacccgtccgttacttccgttacccgaccgtacccctacccgtaaacccgaccggtcccgtaccgttcccggttcccccg

SEQ ID NO: 106160 - DNA, 756 bp, Homo sapiens
  misc_feature: GYAE6OF01CVBPM.36.59.F04.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (337)..(337): a, c, t, g, unknown or other
  misc_feature (337)..(337): n is a, c, g, or t
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
tcagtacgctgtctcacgaccggtgctcgatttagtacacacacttagggatcagggctgaacagagagaactcaccatggagtttgggctgagcgtgtcgtttctaggtcggctagttttaaaggtgtcagtgtgagtgcgaggtgtcggaatcgtgggggagcttggtcagccgtgggggtccctgagctctctgtcgcagtctntggattaacttcgtttagngaactgtgccattagcgttcgtcggtccgacgcgaccgtaccggaggggaagggtcgtaggtacggttcgggtactacgaacgtacttaaagttaaggtgggttaggggtnttaccgttaccaccgactacgttacggaccggtaccggtcgggtcgggggtccttacaacgactacgaccagaccgtacaacacgaggacncgtacgtactagttactcgtacgaaacaaacgngtaacccaacgtcgtaaccgtagaacggtcggtaaccgggaggtaacccgtacggttaccgttaagttattagtcgtaggtacgacggaagtacccgacgtaacgggttaccaaccgttagttacgttacgggtcgttttccggtttttaagtttaccggttttaaccgggaccggtaaacggtacctttaaggtcccggtttaaccgttcccgttacgttacccggtcctaacccggtacccccttaaccggaacccgtacccggtccccgttgtttccccccggttacccccg

SEQ ID NO: 106161 - DNA, 694 bp, Homo sapiens
  misc_feature: GYAE6OF01ES329.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtgggggagcttggttcaggccgtggggggtccctgagactctcctgtgcagtctcgtggtattaatctttagtgactatgccatgatcgtcgggtccgcaggctaccgaggggaagggctgggagtgggtctcgagataaattaagtgggtaaggggttgatttccaaccgtaactagttaccggccggtacctccggggtcgggggtcccgttacaccgtactaccgaaccgagaacgacaaaccgtccaggacgtccacgcctatactcacgaactaaagtcgacaaccacgccgtagaggtacgtacggaacggaacgaccgggtacgttacggttaattacgtttggtacggtacgaaggacgtaaccgtacccgaacgggtacgaacccgtaacgtacgtttaggttcgtttcgttttagtttacgttttttcggaccgtaacgggtaacgtaacgtcggttccgtaccgttcgttcttccgacgtaccccgtaccgaacccgaaccggtcccctaccgttcccgttacccccg

SEQ ID NO: 106162 - DNA, 610 bp, Homo sapiens
  misc_feature: GYAE6OF01B2GVU.36.59.F04.1.454.CMB.1.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (477)..(477): a, c, t, g, unknown or other
  misc_feature (477)..(477): n is a, c, g, or t
  modified_base (527)..(527): a, c, t, g, unknown or other
  misc_feature (527)..(527): n is a, c, g, or t
  modified_base (569)..(569): a, c, t, g, unknown or other
  misc_feature (569)..(569): n is a, c, g, or t
tcagtacgctgtctcacgaccggtgctcgatttagtacacacacttagggatcagggctgaacagagagaactcaccatggagtttgggctgagcgtgtcgttttcttaggtggcttagttttaaaaggtgtcagtgtgaggtgcaggtgtcggaatcgtgggggaggtcgttggttcaggccgttcggggggtcctagagctctcctgtgctatctctggtattaatcttagtnatatgccatgatcgtcggtccgcgacggcncgaggggaaggtctgggtgtggtcncgagctaagttagtggggtaggtntagtcaacactagtacgcggtacgtcgggtcggggtcctcgactnacgaccgaanacgaactacaccgaggacacgacgtanatctactanacgtaaangaccacgtcctaggagaaggacgtacgggagaaccgtacgggtacgttagtagttattggacgngacgtaacgtctaaccccggtacggtcgaacctagtagtttcgtcgtttntttcgtttaggtttacgcgtaacgtactacgtgtacgtcctnttctacgctaccctaccgacttcgccctgtccttaccccgg

SEQ ID NO: 106163 - DNA, 869 bp, Homo sapiens
  misc_feature: GYAE6OF01B0VGP.36.59.F04.1.454.CMB.1.raw
tcagtacgctgtctcacgaccggtgctcgatttagtacacacacttagggatcagggctgaacagagagaactcaccatggagtttgggctgagctggctttttcttgtggcttgttttaaaaggtgtccagtgtgaggtgcaggtgtcggaatcgtgggggagcttggttcagccgtggggggtccctgagactctccgtgtgctagtctcgtagtattaattcttttagcgtacttatcgcctagttgtacgttcggtcggggtcccgaccgacggtcccgttaccgggaagggggtaacggggtcgttaggggaacgggttcgggttcctacgaacggtacgtaaagtttaagggttggggttaagggggttctaacgttaccgaacctaaccggttaacgttaacccggggaccggggttaaccggttccgggggttaccgggggggacccttttaccgaaccgtacgtaccgaaaccgtacggtaacgaacctaaaccggtccgtaaaggggaccgccgtaaccgtcctttaatacgttaccgtacgtaactaaacgttggaccctaacggttaccgacccggttaagggaacggttaccgggtaacgggaacggtaaccggtaacccgggtcgtttaggttacctttaggtcggttaccggaacggtacgtaacggtaccctaaccccgggaaggtcccgaccttacgttggtttaggttcgtttacgtttttcggtttaacgttttcccggaacggtacgtaccgtacggttacggtcccttacggtacctttgtacccgacccggtccctaacccggttaccgggaacccgtccccggtttccgtccccggtttacccccg

SEQ ID NO: 106164 - DNA, 566 bp, Homo sapiens
  misc_feature: GYAE6OF01BDR9I.36.59.F04.1.454.CMB.1.raw
  modified_base (278)..(278): a, c, t, g, unknown or other
  misc_feature (278)..(278): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccagggaaggggctggagtgggtntcagcaattaatggtaggggtgattcaccacatacgcggacgtcgtgggggccggttcaccatcaccagagacaactcaggagcacgctatatctgcaaatgacacagcctgagagtcgagacacgccgtgtattattgtagcgagacgatacccgaacggtacgaccactagttacggttacgtcttttagttagtttttttcggccgtacgggtactaagttcggtcctaccgttcttccttacaacgtccctacccaccgaacgggcccagttcccggttccccg

SEQ ID NO: 106165 - DNA, 602 bp, Homo sapiens
  misc_feature: GYAE6OF01B1QQL.36.59.F04.1.454.CMB.1.raw
  modified_base (309)..(309): a, c, t, g, unknown or other
  misc_feature (309)..(309): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtgggggagcttggttcagccgtggggggtccctgagactctcctgtgcagtctcgtggatttaatctttagtgactatgccatgatcgtgggtccgccaggctccgaggggaagggctggagtgggtctcagctaaagttaagtgggtagggtntactttccaccacagttaccggcggtaccgtccgggtggggggcccttcaccgataccaaccgagacgaacgaacctccgaggacgcacgntaatactctagactaaatcgacacncgctgagagtcgagacgacggccgtagtattagtgtgngagacgactaccgacgtcgaaccagtacgttggttcgttcgttttagttacgtttttcggccgtaacggtactaagtcggtacctaccgttcttctcgacgtccctaccgacccgaacggccctacgtccggttccccg

SEQ ID NO: 106166 - DNA, 938 bp, Homo sapiens
  misc_feature: GYAE6OF01B5X2T.36.59.F04.1.454.CMB.1.raw
  modified_base (258)..(258): a, c, t, g, unknown or other
  misc_feature (258)..(258): n is a, c, g, or t
  modified_base (330)..(330): a, c, t, g, unknown or other
  misc_feature (330)..(330): n is a, c, g, or t
tcagtacgctgtctcacgaccggtgctcgatttagtacacacacttagggatcagggctgaacagagagaactcaccatggagtttgggctgagctggctttttctgtggcttgttttaaaaggtgtccagtgtgaggtgcaggtgtcggaatcgtgggggaggcttggttcagccgtggggggtccctgagactctcctgtgctagtctctggattaattctttagtgactatcgcctatgacttccgtgggtcccnccgaggcctccggaggggagggctgggaggttgggtctcgaagtactaagtttaaggtggggttaaggggtntacgtttaccaacccgtaactaggtttaccggaccgggtaccggttcccgggggtacgggggggttcccgtttaccaaccctacgtacccgaaccgaaggaaccgaaccgtaaaccgtacccggaagggaccggacctaaccggtacttaactaacgtttaccgacgaaaccgtaaaagtcggtaacccgtaacgtaaccggtacccgttaaggaacgggtaacgggtacggggaaacccgggaaacccgggtaacccgggggtacccggtttagggttttaacgtttaaggtttacggttacgggaaccgggtaacgggtaaccggtaacccggtaacccccgggtaaaccgggttaaccgaaccccgttaacggttacggtttttagggtttaccggtttttcggttttttaacgggtttttaacgtttttttaccggggacccgggttaaccgggtaaaaccgttaacggtttacccggttacccggtttaccccgtttaccgtttcccgtttaccgtaacccggttacccccgttaaccccggtaaccccggttaaaccgggtaccccccggttaacccggtttccccgggtttaccccccggg

SEQ ID NO: 106167 - DNA, 726 bp, Homo sapiens
  misc_feature: GYAE6OF01AGKT3.36.59.F04.1.454.CMB.1.raw
tcagtacgctgtctcacgaccggtgctcgatttagtacacacacttagggagtcagggctgaacagagagaactcaccatggagtttgggctgagctggcttttctgtggctgttttaaaggtgtccagtgtgaggtgcaggtggtcggaatcgtgggggagcttggttcagccgtggggggtccctgagactctccgtgtgctagtctctaggtattaactcgtttagtgacttatgacctatgatcgtcgggtccgccgaggtctaccggaggggaagggctagggaggttgggtctcgaagtactaaagttagtaggggttagggtacgtacgtttaccaacctacgtacgttaccggaccggtacggtacccggggtcgggggtacccgttaccgaaccgtacgtaccgaaccgaggtaacgaaccacgtaccgaggaccgacgacgtacttatacgtacgtagaactaaacgtcgaccgtacgtacgtaccgtaggtaacggtacggtaccgggaaacggtaccggtacgggtaccgttagttaacgtttacgttggacgacgtaggacgtacctacccggacgttacgacctagtagttcggttgttcgtttagttacgtttcggaccgtaggtaactaggtcgtaccgtccgttcctcgtacccgtaacgtccgttaacccgacggtacccggtcccttacggttcccgttacccccgg

SEQ ID NO: 106168 - DNA, 773 bp, Homo sapiens
  misc_feature: GYAE6OF01B9BR0.36.59.F04.1.454.CMB.1.raw
  modified_base (322)..(322): a, c, t, g, unknown or other
  misc_feature (322)..(322): n is a, c, g, or t
tcagtacgctgtctcacgaccggtgctcgatttagtacacacacttagggatcagggctgaacagagagaactcaccatggagtttgggctgagctggtctttttcttgtggctgttttaaaaggtgtccagtgtgaggtgcaggtgtcggaatcgtgggggaggcttggtcagccgtggggggtccctgagactctcctgtgctagtctcgtggtaattaattctttagtgactatcgcatgatcgtcgggtccgccgaggctaccgaagggggaagggctgggacgtgggtctcgagactaaagttagtgggtaggggtntattccgaaccactagttaccggcggtacccgttcgggtcggggggtacctttacgaacctactaccgaaccgaagaacgaacctaaacgccgaagggacacgaacgtactagtaatccgtagaactaaagcgaccatacgacctaggaagtacggtacggaacggtaaccgacggggttaccgtaagtttaattagtttacggacgaacggtaactaacgtaacccgtaacccggtaacggtacgtaaccgttaacgttaacggtttggttacgttttacgttttaacggtttacgttttaaccggaaccggttaacggttaaactaacggtttcccggtaacccgttaacccgttccgttaccccgttaacgtaaccccgtacccggttaaaccccaacccgggttaacccgtaaccccgtttaacccggtccccgtttaaccccccgg

SEQ ID NO: 106169 - DNA, 829 bp, Homo sapiens
  misc_feature: GYAE6OF01ENF47.36.59.F04.1.454.CMB.1.raw
  modified_base (743)..(743): a, c, t, g, unknown or other
  misc_feature (743)..(743): n is a, c, g, or t
tcagtacgctgtctcacgaccggtgctcgatttagtacacacacttagggatcagggctgaacagagagaactcaccatggagtttgggctgagctggtctttttcttgtggcttattttaaaggtctctgtgaagcctctggattctacctttgacaagtgtgccatcgaccgtgggtccgcgaggctccgaggggagggctggagtgggtctgtagttagttagtggtaggtggtagtagcaactagtattacgcaagtaccgttccggtaggaacggggtccgttacaacccgtactcctaccgaagaacgaactaaacttacccaaacgacgaccgtaaccgtccgtttaggtttaacttttcggacctaacgtagtaacgaacgtacgccgtaaggacggacggaccggaacggtaccgaccggtacctaagttaactttattagttcgtacgttaaccgttaacctttttccgttttagtacgtttaggtttaaccttaccttacccgttaggtaccgtaaccgtacgggtacggggtaccgtaaccggggttaaccccgttcggtacccgtacccggttcccttaccccgtacgtaccccgaaccccgttaccccgaaccggtaaccccgggtccctacggttcccccgtttacccccgttcccccggtaccgtacccctaccccgttacccgacgtaaccgccgacccgtacccggttcgggaccgggtaacccncggaccccggtccgggtcccggttccggggaccgttccggaccgtttacggggaaccctaacggttaccttaccgtcccgaaacgg

SEQ ID NO: 106170 - DNA, 694 bp, Homo sapiens
  misc_feature: GYAE6OF01A6NGM.36.59.F04.1.454.CMB.1.raw
  modified_base (311)..(311): a, c, t, g, unknown or other
  misc_feature (311)..(311): n is a, c, g, or t
tcagtacgctgtctcacgaccggtgctcgatttagtacacacacttagggatcagggctgaacagagagaactcaccatggagtttgggctgagctggctttttcttgtggctgttttaaagtgtccagtgtgaggtgcaggtgtcggaatctgggggagcttggttcagccgtggggggtccctgagactctcgtgtgcagtctctggattaatctttagtgactatgccatgatccgtgggtccgtccgaggctaccgaggggaagggcgtgggagtgggtctcagctaaagttagtgggttaggggtntacgttccaacctactacgtttaacggccggtacgtccggggttacgggggggtccccgttacaccgtactcgaacccgaggaacgaccaaccgtcccgaaggacgtccaacgctataactcagtaacaaagtcaccacgacgctaggagtacggtacggaacggaccggacgggtaccgttacgttagttttagttaggttggacggaaggacggtacctaccccgtaacgggtaccgtaacccaacgttacgtttcgggttgtttacgtttttggtttacgttttttcggaccgtaacgggtactacgtacggtccgtaccgttctccgttcgtaccgtaccctaccacccgtacggtcccgtacgttcccggttcccccg

SEQ ID NO: 106171 - DNA, 835 bp, Homo sapiens
  misc_feature: GYAE6OF01DLA3L.36.59.F04.1.454.CMB.1.raw
tcagtacgctgtctcacgaccggtgctcgatttagtacacacacttaggagtcagggctgaacagagagaactcaccatggagtttgggctgagctggtctttttctgtggcttgttttaaaaggtgtccgagtgtgagtgcaggtgtcggaatcgtgggggagcttggttcagccgtgggggtccctgagctcgtcctgtgcagtctcgtcggtattaactctttaagtcgtaacttatcgacccaatcgaattccgtggggtcccgacctaggggtcctaccgaaaggggacgggtaccgtagggtacggtgggttacctcgtaagtttagttagttaggtagtacggttagtagtacacgtagacttacgcaggccttacgtagaacggtccgtaccacgtactccgtacgacgaacgactaaactccctaaacgacgaccgaacgtacgttacgttagtttacgacctactacgtacgaacgtaacgtcccgtaaggaacggaaccggacggacggaaccgtaacggtaccctaagttaagttacgttttaacgttggtaccgttaacgtttaaacccggttttccgttttacggttaacgtttacggttttaaacctttaccggttaccccgtaacgttaccggtaaccccgtacggttaccgggggacccccgttaaaccggggtaccccctttacgggtaccccgtaccccgtttacccgttcccccgtttaacccgacccggtttaccccctaaaccccggtaaacccccgaacccgggggtaccccttaaccggttccccgggtttacccccctttaccccccggg

SEQ ID NO: 106172 - DNA, 732 bp, Homo sapiens
  misc_feature: GYAE6OF01CI7H3.36.59.F04.1.454.CMB.1.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
  modified_base (467)..(467): a, c, t, g, unknown or other
  misc_feature (467)..(467): n is a, c, g, or t
  modified_base (500)..(500): a, c, t, g, unknown or other
  misc_feature (500)..(500): n is a, c, g, or t
  modified_base (621)..(621): a, c, t, g, unknown or other
  misc_feature (621)..(621): n is a, c, g, or t
tcagtacgctgtctcacgaccggtgctcgatttagtacacacacttagggatcagggctgaacagagagaactcaccatggagtttgggctgagcgtgtcgttttctaggtggctagttttaaaaggtgtcagtgtgaggtgcgaggtgtcggaatcgtggggggaggtcgtttggttcgacgtcccggttcgggggggttcccctggaagaccttccgtcctgttgctagttccttgtaggtatttaattcttttagtgacttatcgccngtagctcgtcgggtcccgaccgnggtccgtaccggaggggaacggggtgttgggacggttcgggtcctagacggtaattaaaggtttaaggtggggttacgggtnttaacgtttccaaccctaagtacttaccgggccgttacggttccggggtcgggggtccctacctacactccgaaccagacctaacgtaacncggaaggacctacgacgtacttaatcgtctaanactacgtcgactacgacgtcgtagacggtacgtacggacggtacgtacggtacgttagttagttacgtggcgacggagtacgaccggtaccgacggtacacgtagttagttgttacgtttnttttacggtttcgtttaccggacgtacgttacgtaccgtcgttccgtacgttaccgttcctacgtaccgtaccctaccgaacccggtaccgtcctcccgttccccgttccg

SEQ ID NO: 106173 - DNA, 1034 bp, Homo sapiens
  misc_feature: GYAE6OF01BT94C.36.59.F04.1.454.CMB.1.raw
  modified_base (242)..(242): a, c, t, g, unknown or other
  misc_feature (242)..(242): n is a, c, g, or t
tcagtacgctgtctcacgaccggtgctcgatttagtacacacacttagggatcagggctgaacagagagaactcaccatggagtttggctgagctggtctttttcttgtggcttagttttaaaggtgtccagtgtgaggtgcgaggtgtcggaatcgtgggggagtcgttggttcacggccggttgggggtccctggacgtaccttcctccgtgtgctagtctcgtgtattattcgtttagngactatcgcatgtacttccgtcgggtcccgaccgacggtcctaccggaaggggtacggggtcgtagggtacgggttcggtcctaccgagaccgttaaaagttaagggtggggttaaggggtcgttaactttacccgaaccgtaacttaacggtttaccgggaccgggtaccccgggtttaccgggggtaccggggggggtacccctttacccaacccgtaacgttacccgaaaacccgtacggaaaccgtaacctaaacccggttcccggaaagggaacccgaccggtaaacccgttactttaaacttaccgtttaacgtaccgttaaacccgaaaagttcccgggaacctaacccgtaaccgggtacccgttaagggtaaacgggtaaccgggtttaccggggaaacccggttaccccgggtaaccccggggtttccggttaggtttttaacgtttaacggttcgggttaaccggtaaccggtacgggttaaaccgtaaccccgttaccccccgggtaaaacggttccctaaaaccccgttacggttttaacggttttcggggttttaccgttttttaaccggtttttttaaggttttacccggttttttcccgggaaaccgggtttaaaccgggtaccgttaaacgggttttcccggttaaccccggtttacccttccgtttacccccgttaccgtacccccggtttcccccgtaaaaccccgggtacccccgggtaaaccgggtttaccccccgttaccccgggtttcccccggtttaccccccccggg

SEQ ID NO: 106174 - DNA, 856 bp, Homo sapiens
  misc_feature: GYAE6OF01EIP92.36.59.F04.1.454.CMB.1.raw
tcagtacgctgtctcacgaccggtgctcgatttagtacacacacttagggattggggagctctgagagaggagcccagccctgggtattttcgaggttgtttttcattttggtgatcgaggctgaacagagagaactcaccagtggtaggtttgggctgagcttggttctttttcgttggtggtctttaggtttttaaaaggtgtcctaggttggtggagggttgacgtagggttggtacggtaagttcgggtggggggtacggtcgtttcgggtttccgacggtcccgggttcgggggggttccccttagggacgtaccttccgtccgtggttcggacctaggttccttgttaggtaattttaaactttcgttttaagtcgtaaccttagtacgtacctagtgtactccggttcggggtcccgacgacggtccgtacgggaggggacggggcgtgggaggttcggtctacgtagtacttaaaggtttaaggtcggggttagggtacttaacgttaccaacccgtaacgtacgttaccgggaccgggtacggttcccgggggtacgggggttcccgttaccaaccgtacgtaccgaaccgtaaggaaccgtaaccgacccgtaccgagggaacgtaccaacgttactaagttactacggtacaacgtaagtaccgaccaacgtaccggtaccgtaggtaacgggtaccggtaccgggaacggtaccgtaccgggttccgttaagtttaacgtttagttcgggaaccggtaggtaaacggtacgggaaccctttaaccccgggaacggttaaccgaaccccgttaaaggtttggtttacggtttcgggtttttaacg

SEQ ID NO: 106175 - DNA, 964 bp, Homo sapiens
  misc_feature: GYAE6OF01EYPZZ.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtgggggagcttggttcaggccgtggggggtccctgagactctcctgtgcagtctctggtattaatctttagtgactatcgccatgatcgtcgggtccgcaggctccgaggggacgggctgggaggtcgggtctcgagactaaagtttaagtgggtaggggttgtaattccaaccgtacgtaacgttaccgggccggtaaccgttccggggtacgggggggtcccgtttaccgaaccctagtcccgaaccgtaaggacggaaccaaaccgtccgtaagggacgacctaaccggtaccttaattaacgttccgtacgtaaaccgtaaaagtcggtaccctaaaccgtacggtacccgttaacggaagggtaacgggttaccgggaaaccgggtaacccggaacccggggttacccggtttaacggttttaacgtttttacggtttacgggttacgggtaacggtaacgggtaaccggttaacccgttaaccccgggtaaaccgggtttaaccggaaaccccgttaacccggtttaacgggtttacgggttttaccggttttacggtttttttacggttttaacgggttttttttaccggggaccccgggtttaaaccggggttaaacccggttaaacggttttaccccggggtttaacccgtttaaccccgggttttccccgtttacccgttttaaccccgggtaacccggttacccccccgtttaaccccggtaaaaccccccgggttaaaccccggggtaccccccgtttaaaccccgggtttaccccccggggttttcccccccccgg

SEQ ID NO: 106176 - DNA, 768 bp, Homo sapiens
  misc_feature: GYAE6OF01DH1FY.36.59.F04.1.454.CMB.1.raw
  modified_base (330)..(330): a, c, t, g, unknown or other
  misc_feature (330)..(330): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtggggggagtcttggttcagccgtggggggtccctgagactctctgtgcagtctctggtattaatctttaagtgactatcgaccatgactcgtcgggtcccgccgaggcctccgaaggggaagggtctgggaggtgggtcctgagactaaatttaaggtggggttaacgggggtntaactttccaaccaacgtaacgttacggccggaccggttccggggtgggggggtaccccttcaaccgtactacaaccgaagacgaccaaacgtccgaagggacgccaacgctaatactctagaactaaatcggaccaacgacgtaccgtggaaggtacggtacggaacgggaccgtaacggggtaccgttagtttaagtttaggttacgttcggacggaaggtaacgtaccgtaccccggtaacgggttaccaaccgttaacgttaggttttacgggttacgtttcgttttttaacggttttacgttttttacccggaccgggttaacgggtaacgtaacggttcggtaacccgtacccgttactttccgttacccgtacgtacccctacccggtaacccggaaccggtacccctacggtttccccggttaccccccg

SEQ ID NO: 106177 - DNA, 1163 bp, Homo sapiens
  misc_feature: GYAE6OF01C6FY4.36.59.F04.1.454.CMB.1.raw
tcagtacgctgtctcacgaccggtgctcgatttagtacacacacttagggatcagggctgaacagagagaactcaccatggagtttgggctgagctggtctttttcttgtggctagtttttaaaaggtgtccagtgtgaggtgcaggtgtcggaatcggtggggggaggtcgtttggttcacggtcccggttcgggggggtcccctggacggtacttctccgtgtcgcagttctcgtaggtattaactttctttagtgtacttatcgacctagtagtacgttccggtcgggtcccgaccgacgggtccgtaccgggaaggggggtacgggggacgttaggggtacgggttcgggttacctacgaaggttaacgtaaaagttttaaagggggttcggggggttaaggggggtttctaaaccttttaacccgaaacccgaacgtttaaaccggtttaaccggggtaccccggggttaccccgggtttccccggggggggttcccgggggggggttaacccccgttttaccccaaacccgtaacccggttaaccccgaaaacccggtaagggaaaccccgtaaaccctaaaaccccgttacccgggaaaagggtacccggacccctaaacggttacctttaaaacgtttacgtacccgttaaacggaaaacctaaacggttaccggaacccaaccgtaccggtccgtaaacgggtaaagggttaccgggaaccggggtaaaccggtaacccgggtaacccggggttaccgggttttaagttttaacggtttaacggtttcgggtaacgacgggttaacggtaaccccggtaaccggtttaaccccgggaaaccgggtttaccctaaacccggttacgtttttaggggttttaccggtttttaacggtttttaccggtttttttttacgggttttttaaccggggtttttttaaccccggaacccgggttaaaccggggttaaaccgtttaaccggggttttccccggtaacccgggtttaaccccccgtttttcggtttaccccgtttaaaccccggttaacccccggttaccccccgttaaacccccgggaaaccccggggtttaacccccgggtaaccccccgttaccccgggttttccccccgggttttaacccccccccggg

SEQ ID NO: 106178 - DNA, 606 bp, Homo sapiens
  misc_feature: GYAE6OF01DAK7G.36.59.F04.1.454.CMB.1.raw
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
  modified_base (468)..(468): a, c, t, g, unknown or other
  misc_feature (468)..(468): n is a, c, g, or t
tcagtacgctgtctcacgaccggtgctcgatttagtacacacacttagggatcagggctgaacagagagaactcaccatggagtttgggctgagcgtgtcgttttctagtggctagttttaaaaggtgtccagtgtgaggtgcaggtgtccggaatcgtgggggaggcttggttcagccgtgggggtccctgagactctctgtgcngtctctggattatctttagnactatgccatgatcgtgggtccgacncggtcaccggaggggaggcgnggcgtgggtctnagtgaattaagtgggtagggtgattaccaccatacttcggccggaccgttcgggcgggggtaccgtttccgaactcacgaccaggacgtacaaccaccgaggganactacgtctaatactcgtagacaaagtcacacacggaccngagtacgacggagacggacgtacgttagttattagtgngagagacgactaccgaacggtcactacgttgttcgttcgtttgttttgttcgtttacggaccgtacgtacgtaggtcgttaccgtcttccttctaccgccgtacccgaaccgacgacccggcctccgttcccgtcccg

SEQ ID NO: 106179 - DNA, 1037 bp, Homo sapiens
  misc_feature: GYAE6OF01BO1LN.36.59.F04.1.454.CMB.1.raw
tcagtacgctgtctcacgaccggtgctcgatttagtacacacacttagggatcagggctgaacagagagaactcaccatggagtttgggctgagctggtctttttcttgtggcttagttttaaaggtgtccagtgtgaggtgcgaggtgtcggaatcggtgggggaggtcttggttcaggtccggtcggggggtccctgacgtaccttccgtccgtggtcgcgtacgttcttcgttggttaactttaagtttcgtttagtacgtaacttagtcgacctaagtgtaccgttccggttaccgggttcccgacccggtacggtaccggtaaccggggaaggggggtaacggggtccggttagggtacggggtcggttacgaccgtaaggtaaccttaaaaggttttaaggttagggggttaacgggttagttaaccgtttaccgaacccgtaacgttaaccggttaccgggtacccgggtacccgggtttccggggggttacccgggggtacccggtttaaccgaacccgtaccgttacccgaaccggtaacggaaaccgtaacccggtaccctaaccgggaacgggaaccgtaccgtaaccttaccgttaaactacgtttaccgaccgtaaaacgtaaacccgttgaaacccgtaacggtaccgtacccggttaaggaacgggtacggtaacccgggaaccgggaccggtaacccggttaccgggtttaagtttacgtttaacggttcgggtacgtaacggggaacgtaacccggttaaccgtaaccccgggtaaccggttaaccgaacccttaacggtttcgtttacggtttacggtttttagtttttaaccggttttcgggtttttaaaccggacccggggttaaacggttaaccggttaaaccggttttcccgggtaaaccctttcccggttaaccgtttccccgttacccgtaccccgttacccccgtaacccggtaaccccgggttaaccccggttcccgttaacccccgggttttccccgggttacccccccc

SEQ ID NO: 106180 - DNA, 822 bp, Homo sapiens
  misc_feature: GYAE6OF01B652P.36.59.F04.1.454.CMB.1.raw
  modified_base (218)..(218): a, c, t, g, unknown or other
  misc_feature (218)..(218): n is a, c, g, or t
tcagtacgctgtctcacgaccggtgctcgatttagtacacacacttagggatcagggctgaacagagagaactcaccatggagtttgggctgagcgtggtcgttttcttaggtggcttagttttaaaaggtgtccagtgtgaggtgcaggtgtcggaatcggtggggggagcgttggttcaggccgtggggggtccctggacgacttctcctgtcgcnggtctcgttggtaatttaattctttaggatacttatcggacctataggacttcggtcggggttacccgccgtaaggtccgtaaccgggaaggggggaagggtcgtagggacggttcgggtctagacgtacgtaaagtttaggtggggtagggtgtacgtccaacgtactacgttaccgggccggtaccggttccgggggtcgggggtcccttaaccgacctacgtacccaaccgagaaccgaacctaccgtacggaagggactaccggtaacgcttaacttacgtcgtaaacaacgtaaacgtgaacccacgtagacccgtaggaaggtacggaccggaacggaccggtacggtccgtttagttacgttagtttcggacggacggtacgtaacgtacccgtaaccgtaacgggtaccgtaacctacgttagggtttcggttacgttttaacgttttggttttacgttttaccgggaccggttaacggtacgtaaccggttacgttacccggtaccgttccgtttacccgttccgtacccgtaccccgtaccccggaacccggtacccgggttaccccttacccggttccccggtttccccccgg

SEQ ID NO: 106181 - DNA, 869 bp, Homo sapiens
  misc_feature: GYAE6OF01C8PYK.36.59.F04.1.454.CMB.1.raw
  modified_base (337)..(337): a, c, t, g, unknown or other
  misc_feature (337)..(337): n is a, c, g, or t
tcagtacgctgtctcacgaccggtgctcgatttagtacacacacttagggatcagggctgaacagagagaactcaccatggagtttgggctgagctggctttttcttgtggctagttttaaaaggtgtccagtgtggaggtgcaggtgtcggaatcgtggggggaggtcttggttcagccgtggggggtccctgacgactctcctgtgcagtctctggtattaattctttagtgactatcgcatgtatcgtcgggtccgccgaggccgtaccggaagggggacggggtcgtgggaggttcgggtcctagacgactaagttaaggtggggtaggggtntacgttaccaaccgtactaacgttaccggcggtaccggttccggggtcggggggtccccgttaccaaccgtactaccgaaccgaggaacgtaaccgaaccgtaccggaacggtacggaccaccgtaacgtacttacgtactacgaactaaacgtacggacctaacgacggtaccgtagggaacggtacggtaacggaacgggtaacccggaacggttaccgggttagtttacggttttaaggttcggtacggtacggaacggtaaccggtaaccgttacccccggaaacggtcccgaacccgttaacggttacggtttacgggtttcgttttacggtttttttaacggttttacgggttttttaccgggaaccccgggtttaacggtaaacccggttaacggttcccgggttacccttaccccggtttaccttttcccgttacccggttaaccccgttaccccccgtacccggaaaaccccgggtaccccgggttaaccccttcccgggttccccggttttccccccccggg

SEQ ID NO: 106182 - DNA, 643 bp, Homo sapiens
  misc_feature: GYAE6OF01DGRSL.36.59.F04.1.454.CMB.1.raw
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
tcagtacgctgtctcacgaccggtgctcgatttagtacacacacttagggatcagggctgaacagagagaactcaccatggagtttggctgagctggtctttttcttgtggcttagtttttaaaaggtgtccagtgtgaggtgcaggtgtcggaatcgtgggggagcttggttcagcgtgggggtccctgacgctctcctgtgctagtctctggtatttaatcttttaggatactatcgacctagtgatcgtcggtccgcaggctcgagggagggctggagtggctgagactaagttagtgggtagggtntatcgacatagtacgnggtactcgggcgggtctacactagcacgagacgaacacgtcgagacacacgacttaatacgtctacgaaactaagtcgacacaacgaccgttaggaggtaactaccggggaagaacccgtacgggtccgtttaagttaacgtttaggttggttacggacgtaggaactaccgtaaccccgaaggtccaacctacgttagttcggttattcgttttacgttagttttccggacgtacggtactacgttcggtacctaccgtcgttccttacggcctacccctacgacccgaacggtccccttggtccccgttccccgg

SEQ ID NO: 106183 - DNA, 670 bp, Homo sapiens
  misc_feature: GYAE6OF01CSKWE.36.59.F04.1.454.CMB.1.raw
  modified_base (331)..(331): a, c, t, g, unknown or other
  misc_feature (331)..(331): n is a, c, g, or t
  modified_base (615)..(615): a, c, t, g, unknown or other
  misc_feature (615)..(615): n is a, c, g, or t
tcagtacgctgtctcacgaccggtgctcgatttagtacacacacttagggatcaggactgaacagagagatctcaccatggtaatttgggctgagctggtctttttcttgtgcttaattttaaaggtcgtccagtgtagaagtgctagttggttggattcggtggggggagtcgttgggtacgacggggtcccgggggggtcctgagtactcctctgtgcagtcttcgaggtactcagtcttagcagcctacgccagtgacgtcggtcgggtccgcgacggctcggaaggggaagggtccgtgggaggttggtctacgtaggttgttgggnggcgtaggtcggtacgacggacctacgtataccgtcgactacggtacctccgggtaggtaccgggtcccgttacacgtactaccgtacgaaggactaactaacgtaccaaacgtaaccctacccgttgtactacgtacgaaactaacgtcgaaaccgtaccgaggtaacgacggtaccgaacgaccgtaacggaccttattacgtaacgtacgtaaacgagtccggactaggtatacgtaatcctagtagtgcgttgtactcgtcgtcgtggtccggtcgtacnccgtacgtcgtctacgtcgtacctccgtacgacccgactcccgtaaccgtaccgg

SEQ ID NO: 106184 - DNA, 819 bp, Homo sapiens
  misc_feature: GYAE6OF01ALQ5B.36.59.F04.1.454.CMB.1.raw
tcagtacgctgtctcacgaccggtgctcgatttagtacacacacttagggatcagggctgaacagagagaactcaccatggagtttgggctgagctggctttttcttgtggcttgttttaaaaggtgtccagtgtgaggtgcaggtgtcggaatcgtgggggagtcttggttcagccgtggggggtccctgagactctcctgtgctagtctcgtggtatttaattcgttttagtcggtaacttatcggacctaagttgacgttccgttcggggttccccgccggacgggtccgtacccgggaagggggaagggggtccttaggggacggttcgggtactcgaacggtaactaaaaggtttaaggtgggggtaaggggttgtaactttaccgaacctacgttaagttaccggacggttacccggtccggggtcgggggtccccgttacacccgtactccgaaccgaggaccaacgaaccgtacgaggacgacgtacgtactaagtactacgtacgaactaagtcgactacgacgtcgtagaacggtcggtaccggaagggtacccgaccgggtaccgttagtttaactttaggtcggtacggccggtaagaccgttaaccgtaaccccggtacggtaccgtaaccctacgttagtttcgggttcgttttacgtttttacggttttcgttttaccggaccggttacgggtaaccttacgttccgggtaacccttaccgttcttacccgttacgtacccggtacccccttacccggaaacccggttacccggtccccttaggttcccccggtttaccccccg

SEQ ID NO: 106185 - DNA, 754 bp, Homo sapiens
  misc_feature: GYAE6OF01ET5DK.36.59.F04.1.454.CMB.1.raw
  modified_base (156)..(156): a, c, t, g, unknown or other
  misc_feature (156)..(156): n is a, c, g, or t
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
tcagtacgctgtctcacgaccggtgctcgatttagtacacacacttagggatcagggctgaacagagagaactcaccatggagtttgggctgagcgtgcgttttctagtggctagtttaaaaggtgtccagtgtgaggtgcaggtgtcggaatcgngggggagtcttgggttcacgcgtgggggtccctgacgtactctcctgtcgccngtctctggtattaatcgtttagagtacctatgacctagtgatcgtgggtaccncccgaaggccgtaccggaggggaacggggtctgggtagttcgggtactcaggctaaaagttcgtagggtaggtgtatccgaacctacgtaaggttccggaccggtacgtccggggtcggggtacccgttaccgacctattacccgaaccgtaggaaccgaaccgtaacctccggaaggtcgtacaaccggtctaatacgtcgagtaaccaagtcgactacgacgtctaggtagtacgacggacggtcgaacggtccgttattaacggttagtggacccgtaggagtacgtaaccgtccgtaaggacccggttaacaccggttaagggttgtccgggttttacttaacggttttaggtttccggaaccccggtaaaggttactaaacggttcccgtaacccggttaaccgtttccgtcccgtttacccgacgtacccttacccgggaacccttaaacccggggttcccctaaacggttcccccgttacccccg

SEQ ID NO: 106186 - DNA, 726 bp, Homo sapiens
  misc_feature: GYAE6OF01ANX2D.36.59.F04.1.454.CMB.1.raw
  modified_base (356)..(356): a, c, t, g, unknown or other
  misc_feature (356)..(356): n is a, c, g, or t
  modified_base (473)..(473): a, c, t, g, unknown or other
  misc_feature (473)..(473): n is a, c, g, or t
  modified_base (496)..(496): a, c, t, g, unknown or other
  misc_feature (496)..(496): n is a, c, g, or t
  modified_base (547)..(547): a, c, t, g, unknown or other
  misc_feature (547)..(547): n is a, c, g, or t
tcagtacgctgtctcacgaccggtgctcgatttagtacacacacttagggatcagggctgaacagagagaactcaccatggagtttgggctgagcgtggtcttttcttggtggctagttttaaaaggtgtcagtgtgaggtgcaggtgtcggaagtcgtgggggagtcttggttcagccgtggggggtccctgagacctctcctgtgcagtctcgtggtattaattcgtttagtgtaacttatcgcctaagtgtactcggtcgggtacccgccgtacggtccttaccgggagggggtaacggggcttgggaggttgggtctcgtaggactaagtttaaggtcggggtaaggggttntacgttccaaccgagtaacgttcgggaccgggtaccggttccggggtcgggggtacccgttaccaccggatccaaccgaagaaccgacctaacgcgaaggacgcctagtcttaacgntcgtagaactaagtcgactacgngtaccgtggacggagtacggacggaccgacgtcggttatcgttacgtaggngacggtagaacggtactacccggaacgtacgtaaccgtaacgttggtttcggttacgttttcgttttacgtttcgttttaccggccggtaaccggtacttacggtcgtaccgtccgttctcccgttacgtaccttaccccacggtacccgtaaccggtcctacccggttcccgtccccg

SEQ ID NO: 106187 - DNA, 709 bp, Homo sapiens
  misc_feature: GYAE6OF01DYNLU.36.59.F04.1.454.CMB.1.raw
  modified_base (231)..(231): a, c, t, g, unknown or other
  misc_feature (231)..(231): n is a, c, g, or t
  modified_base (354)..(354): a, c, t, g, unknown or other
  misc_feature (354)..(354): n is a, c, g, or t
  modified_base (432)..(432): a, c, t, g, unknown or other
  misc_feature (432)..(432): n is a, c, g, or t
tcagtacgctgtctcacgaccggtgctcgatttagtacacacacttagggatcagggctgaacagagagaactcaccatggagtttgggctgagctggtctttttcttgtggcttagtttttaaaaggtgtccagtgtgaggtgcaggtgtcggaatcgtgggggagtcttggttcagccgtggggggtccctgagactctctgtgcagtctctggaattaattctttagngtactagtcgaccagtgtattccgtcggggtcccgaccgacggtccgtaccggaagggggaacggggtcgtgggtaggtgggtcctacgagtaactaaagtttaaggtcggggtaaggggttntaatttaccaacactacgttaccggcggtaccgtcgggtcgggggcctacaccatccacgagacacacgtcgaagacnctacgtctatctctacgactaaatcgacacgacgtaccgtagaggtacgtacggacggaccgacggtacgttacgttattacgttggtcgacggtaagacgtacgtacccgaacggtaccaaccgtacgtaggtttcgttagttttctttttaggtttacgttttttccggaccggtaacggtacgtacggtacgttccgttaccgttccttccgtaccgaccgtaccccgtacccaacccggtacccggtacccttcggttcccgtttacccccgg

SEQ ID NO: 106188 - DNA, 739 bp, Homo sapiens
  misc_feature: GYAE6OF01AYENP.36.59.F04.1.454.CMB.1.raw
  modified_base (328)..(328): a, c, t, g, unknown or other
  misc_feature (328)..(328): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtggggggaggcttggttcagccgtgggggggtccctgagactctcctgtgcagtctctggatttaatctttagtgactatgccatgatcgtcgggtccgcaggcctccggaaggggtacggggcgtagggtaggtgggtctcgagactaaagttaaggtggggttaggggttntacgttaccgaacctaactacgttaccgggccggtaccggttcccggggtcggggggggtcccgttaccaccgtacgtcccgaaccgtaacgaccggaaccaaccgtaccgaagggacaccgaccgtctaatacgtctacgactaaatcgaacacgacgctaggagacggtggacggaccgacggtcgttagttattagttggtagacggagacgtacctaccggacggtacacctacgtaggtttcggttgtttcgtttttacggttttacgtttttcgggacccggtaacgggtaacttacgggttaccggttacccgtaccgtttcccttcccgttccgacccgttaccccgtaccccggtaaaccgtaacccggggtccccttacgggtttccccggtttccccccg

SEQ ID NO: 106189 - DNA, 954 bp, Homo sapiens
  misc_feature: GYAE6OF01EC0JA.36.59.F04.1.454.CMB.1.raw
tcagtacgctgtctcacgaccggtgctcgatttagtacacacacttaggatcagggctgaacagagagaactcaccagtggtagtttgggctgagtcgtggtctttttcgtgtggtcttagttttaaaggtgtccagtgtggagtgcgtaggtgtacggaattcggtggggagtcgttggtcgacgtccggtcggggtcctagacgtaccttcgtccgtgtcgcgtagttcgttacgtaggtaactttacgttacgttttaggtacgtaacttacgtacgtcccttagtacggtaccgttaccggttccgggtcccgtaccggtaccggtacccggttaacggggaacggggtaaccggggtccggttaaggggttacgggtcgggtttaccctacggtaaaccggtttaaaggttaaacggttttaaggggttacgggggttaacgggggtttaccttaaccgttaacccgtaaacccggttaaccggtttaaccggtttaacccggggaacccggggtttacccggggtttcccggggggttaccgggggttacccctttaacccgaacgttaaccccgttaacccgaaccgtaaacggtaacccgttaaacccggtaaccgtacccgggtaaagcccgtaacgtccgtaaacttacgttacgttacgtaacgtaacgtaaccgtacgaacccgtaaccgtacgtacggaacggttacgggacgaacggtcgaacggttacgttagttacgtattggccgtagtaacggactaccgtaaccgtaacgtcgtacctaagttacggttgtttaacttttcggtttgtttacggtcgacccggtaagtaccgtagtcccgaccggtttacgttccgtacctttgggccccccttaaccgtacccgttaacccgggaacctttcccggtcccgttcccggttcccccgtccccggg

SEQ ID NO: 106190 - DNA, 602 bp, Homo sapiens
  misc_feature: GYAE6OF01CHL3G.36.59.F04.1.454.CMB.1.raw
  modified_base (248)..(248): a, c, t, g, unknown or other
  misc_feature (248)..(248): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctggggggagcttggttcagccgtggggggtccctgagactctcctgtgcagtctctggattaatctttagtgactatgccatgatctgggtccncaggctcgagggagggctggagtgggtctcagctaattaagtgggtagggtgagttcaccacattacgcggactcggtgggggccgttcacagtcaccagacgactaactccgaggacgcacgctatactctagacaaatgacacagcctaggagagtacggaacggacgacggtccgtagttacttacgttggtgacggaagacgtaacgtacccgaacggtccgaactaccgtagtttcggtacgtttcgtttttagttagttttttacggccgtaacggtactaaggttcgtcgtccgttacttccgttccacgtccctaccgtaccgtaacgccccgtgtccgttccccg

SEQ ID NO: 106191 - DNA, 923 bp, Homo sapiens
  misc_feature: GYAE6OF01B5YK1.36.59.F04.1.454.CMB.1.raw
tcagtacgctgtctcacgaccggtgctcgatttagtacacacacttagggatcagggctgaacagagagaactcaccatggagtttgggctgagctggtctttttcttgtggcttagttttaaaaggtgtccagtgtgaggtgcaggtgtcggaatcgtgggggagtcttggttcagccgtgggggtccctgagctctctgtcgctagtctcgtaggtaattaacttcgtttagtgtacttagtcgcctagtgactcggtacgggtccgaccgacggccgtccggaagggggtaacgggcgtagggtacggttgggtacctacgaacgtaacgttaaagttaacggttgggggtaaggggttacgtaacgttaccgaaacccgtacgtaacggtttaccgggccgggtacccggttcccgggggttcggggggtaccccgtttaccgaacccgtacgtacccgaaccgaacggtaacgaacccgtaaccgtacccggaagggaccgtaccgtaacggttacctaagtacgtaccgtacgaaaccgtaagttccgacctaacgaccgtaccgtaggaacggtacggtacgggaacggtaccggtacgggtaccgttagtttaagtttacgtacgggttacgaacggtacggtaacgttaacccggtaacccgtaaccgggtaccgtaacccttaacgggttcgtttacgggtttaccgttttacggttttttacggtttttaccgggtttttaccgggaacccgggttaacccgggtaaacgtttaaccgggttacccggttacccgttaccccggtttacgtttacccgttaccccggtacccgttaccccggtaacccccggaaacccgggttaaccccgggtaccccgttaccccgggttcccccgggttttaccccccgg

SEQ ID NO: 106192 - DNA, 844 bp, Homo sapiens
  misc_feature: GYAE6OF01EOO2Z.36.59.F04.1.454.CMB.1.raw
tcagtacgctgtctcacgaccggtgctcgatttagtacacacacttagggatcagggctgaacagagagaactcaccatggagtttgggctgagctggtctttttcttgtggtcttagtttttaaaaggtgtccagtgtgaggtgcaggtgtcggaatcgtgggggaggtcgttggttcacggccggttcggggggtccctggacgtaccttcctccgtgtcgcctagttcttcgtaggtaatttaacgttcttttagtgtacttagtcgacctagtcgtacgttcggttcgggtcccgaccgtacggtccgtaccggaaggggtaacggggcgtagggtacggttcggtctacgaacgtacgtaaagtttaggtaggggtacgggtactacttacccgaaccgtacgttaaccgttaccgggaccgggtacccggttcccgggggtacgggggtaccccgttacccgaacgtaccgtaacccgaaccgaagaaccgaaacccgtaaccgtccgaaacgggtacaccgtaaccgtacgttaattacgtacgtacgtaaacaacgtcgaccgaacgtacgtccgtagtacggagtacggacgtaccgtacgtacgttagttagttagtcgtagacgtagacgtaccgtaccgtacgtaccgaactacggttaggtttcgttcgttttacgttttacggtttacgttttccggaccggttaaccggtacgttaaccgtccggttacccgttacccgtttacgttacccgttaccggtaccccgttaccccgtaacccgaacccgggtaccgtaccccggtttcccgttaccccggtttccccccgg

SEQ ID NO: 106193 - DNA, 671 bp, Homo sapiens
  misc_feature: GYAE6OF01DWDLV.36.59.F04.1.454.CMB.1.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (464)..(464): a, c, t, g, unknown or other
  misc_feature (464)..(464): n is a, c, g, or t
tcagtacgctgtctcacgaccggtgctcgatttagtacacacacttagggatcaggggctgaacagagagaactcaccatggagtttgggctgagctggtcttttcttgtggtcttagtttaaaaggtgtccagtgtgaggtgcaggtgtccggaagtcggtaggggggaggtccgttggttcacggccggttcggggggtccctggagactcctccgtgtgacgnttctctggtaattatctttagtcgatagtcgacatgatccggtcgggtcccgcgacgccgtacggaggggtacgggnggtggaaggtccgggtntacgaggactaaggttaacgtggggtagggtctacgttaccgacctagtaccggtacggccggttaccggtccggggtccggggtaccgttaccaccgtacaccgagaacgtacgactaccgtcgaggaatccaagctaatacncgtaacagtcagacgacgtcgagagtacgacggacggtaccgtacggtcgttagttagttagtgcgacgaacgacgtaccgaccgtacggtacgaacctacgttagtttgttacgtttgtttagtttacgttacggaccgtagtacgtcgtacgtccgtacttcgttctacgcctaccgtaccgaccgaccgccttcgtcccgtccc

SEQ ID NO: 106194 - DNA, 741 bp, Homo sapiens
  misc_feature: GYAE6OF01A5AEG.36.59.F04.1.454.CMB.1.raw
  modified_base (557)..(557): a, c, t, g, unknown or other
  misc_feature (557)..(557): n is a, c, g, or t
tcagtacgctgtctcacgaccggtgctcgatttagtacacacacttagggattggggagctctgagagaggagcccagccctgggtattttcgaggttgttttcatttggtgatcagggctgaacagagagaactcaccatggtagtttgggctgagctggttctttttcgttggtggtcttaggttttaaaaggtgtcgtagtgtggaggtgcgtaggtgtcggaagtcggtggggaggtctttggtcgacggtcgggtccgggtctgacgtcttctcgtgcgcgtcgtctcgtagttaattacgtttacgttagtagtaccgtatccgtaccttagtcgttacggtccgggttccgggtacccgacggtccggtaccggtaacggggacggggtacgggtaggtcgggtacggtcggtcgtaggtacgtaagttaaggttagggtagggtggtagttacctacctaacgtacgtacggtaccggacggtaccgggtccgggggtacgggtccttaccgacttacgaccgacggaagtacaaccgtaccgaacggngacccagtacctcgttaactccgtacgactagaacgtcaaccgacgaaccggtagaggtacgtacggcggaacgtaccggcggttaacggttagttacgttggtacggcggtaaggtaacgtaccggtaccgtaccgaaacgtaccgtacgtaccggttttaggttccggtttgtttttaacgg

SEQ ID NO: 106195 - DNA, 1096 bp, Homo sapiens
  misc_feature: GYAE6OF01B5TIJ.36.59.F04.1.454.CMB.1.raw
  modified_base (230)..(230): a, c, t, g, unknown or other
  misc_feature (230)..(230): n is a, c, g, or t
tcagtacgctgtctcacgaccggtgctcgatttagtacacacacttagggatcagggctgaacagagagaactcaccatggagtttgggctgagcgtggtcgttttctaggtcggcttagtttaaaggtgtccgagtgtggaggtgcgaggtggtacggaagtggtgggggaggtcgttggttacgacggccgggttcggggggtccctggaacgtcctccgttcgtggngtacgtacgtccttggttagttaactttaaagtttcttttaggagttaaccttagtccgtaccgtaattgacgttccggtccggggttacccgaccgtacgggtccgtaaccgggggaaacggggggtacgggggtcgggttaaaggtaggggttttccggggtaccgtaacgaacggtaacgttaaaaggtttaaagggtttagggggtaggggttccctaagtttaaccccaaccgtttaaacttaaccggggtttaaccggaccccgggggttacccgggtttacgggggggtcccggggggtttaaacccgtttccccgaaacttacccggaaccccaaaagggttacgaaacccgttaaaccgtaaccggaaccggggtaaagggcgacccgtaaccctttaaaaggttcctaaaccgggttccttaaaaccgggtaaaacgtaaacggtacccgaccggttacgggaaccgttcggtaaacgggtaagggtaaccgggtaacggtaaacccggtcccggggttaaccgggttaacggttttagtttaacccggtttgggtaacgggccggtaacgtaacccgggtaccgttaacccggtaacccgggttaccgttaaccggtaacgttttaacggttttccgggttttacggttttcggttttttaaaccgttttgggtttttacccggttaaaccggggtaaccgggttaaaccgggttcgttaaccccgggttccggtttaccccgttaccggttacccgttttcccggaaaccctcccgggttaaccccccggtaaaacccggtacccggtaccccggggttttaacccctttcccggggttcccccgtttaccccg

SEQ ID NO: 106196 - DNA, 864 bp, Homo sapiens
  misc_feature: GYAE6OF01CAKZH.36.59.F04.1.454.CMB.1.raw
  modified_base (485)..(485): a, c, t, g, unknown or other
  misc_feature (485)..(485): n is a, c, g, or t
tcagtacgctgtctcacgaccggtgctcgatttagtacacacacttagggatcagggctgaacagagagaactcaccatggagtttgggctgagctggtctttttcttgtggtcttagttttaaaaggtgtccagtgtgaggtgcgaggtgtcggaagtcgtggggggaggtcttggttcaggccgtggggggtccctggacgactcctccgtgtcgcagttctcgtaggtatttaacttcgttttagtgtactatcgcctatcgtattccgtcgggtcccgaccgaggtcccgttaccggaagggggaaggggtccgtagggtacgtcgggttactcgaagtacgtaaattaaggtggggtaggggtactactttaccgaccactacggttaaccggccggtacccggttccggggtcggggggtcccgtttaccaacccgtatacccgaacgacggaacgtaaccaaccgtccggaaggaacncgtaaccgtacctaattcgcctacggaaccttaagaccggacctaagaccgtccgtagggacgtacggaccggaacggtaaccgtacgggtacccgttagtttacgttagtttcgggtagtacggtaacgtaacgtacccgtaaccccgggtaaccgtacgttaaccctaggttaccgttttacgggtttacgttttaccgtttttaacggttttacgggtttttttccgggtaacccgggtaaacggttaaccgttaaacggttccgttaccccggttacccgtttaccgttcccgttaccccggtaacccgttaccccggacccgttaaccccggaacccgggtacccccttcggttaccccccggtttccccccgg

SEQ ID NO: 106197 - DNA, 806 bp, Homo sapiens
  misc_feature: GYAE6OF01BNWZU.36.59.F04.1.454.CMB.1.raw
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
tcagtacgctgtctcacgaccggtgctcgatttagtacacacacttagggatcagggctgaacagagagaactcaccatggagtttgggctgagctggtctttttcttgtggcttagttttaaaggtgtccagtgtgaggtgcaggtgtcggaatcgtgggggagtcgttggttcgaggtccggtgggggtccctgacgtactcctctgtgctagtctcgtaggtaatttacttctttagtgtacttancgacctatgtatcggtcggtccncgtacggcgtcggagggaggcgtggagtcggtctacgagtacttaagttaggtagggtagggtcgtactaccgacctaacgtacgtaccggccggtaccggtccggggtcggggtacctaccacgactaccgacgtacgacgtaaccacgtaccgaggtacgacaccgtacttaactacgtcgtacgtaacgaacgtcgtacaacgtccgtacgaggtaacggtacggtaaccgggaaacggtacccggaacgggtttcctttaaggtttaacgtttaccggttagaccgggtacggtaacggtaccgtacccggtaacccggtaacggtcctaaaccgttacggtttaggtttcggtttaccgtttttacggtttttacggtttccgtttttaacccggaacgtaccggtaaacgttaacgttacggtaccggtttacccttacccggtttccttacccgtcccgtaacccgttacccccgtaacccgggaacccggtaacccggttccccgttaacccggtttcccccccgg

SEQ ID NO: 106198 - DNA, 934 bp, Homo sapiens
  misc_feature: GYAE6OF01BY34U.36.59.F04.1.454.CMB.1.raw
tcagtacgctgtctcacgaccggtgctcgatttagtacacacacttagggatcagggctgaacagagagaactcaccatggagtttgggctgagcgtggcttttctgtggctgtttaaaggtgtcagtgtgaggtgcagggtgtcggaatcgtggggggaggtcgttggtttcacggtccgtcgggggggttcccctggagtacctcctccgtgtcgactcgttctcgtaggtattaacgttctttagtagtactagtcgcctatcgacttccgtcgggtcccgaccgtacggccgtacggaggggtaacggggtcgttggggagggttcgggtctacgagtaacgtaaattaggggtaggtaggggttagtacttaccgactacgtaacgttccggaccggtaccggtcgggggttaccgggggtcccgtacctaccgtacgtcgaacccgtaacggacgtaaacccgacctaaccggagggtacccgaccggtaacggtaccttagttactaccgtacgtaacaacgttaccggaccgtacctacggtaccggtaggaaccgggtacgggtacggtaaacggtaaccccgggcgttttaaccggtttaactttttaaccgggttccgtaccgggtaacggacgggttaaagggaaaccggggttaaccgggtccggtttaaaccggggggttcccggttttaaccggtaaccgggtttccccggggtaccggggttaaccccgggtaacccggggttacccccggtttgggtaccccgttacccgttaaccccgttcccgaacccggttccccgggtaccccctaaccccgtaaacccgggccccccgggttaccttacccccggtaccccgggtttaccccccttcccccggggtacggtaccccccgttcccggacccgggtacccccgg

SEQ ID NO: 106199 - DNA, 521 bp, Homo sapiens
  misc_feature: GYAE6OF02IBLY7.36.59.F04.1.454.CMB.1.raw
  modified_base (310)..(310): a, c, t, g, unknown or other
  misc_feature (310)..(310): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccagggaaggggctggagtggggtctcagcaattaatggtaggggtgattcaccanattacgcggactccggtggggggccgttcaccatcaccagagacaactccaggagcacgctatatctgcaaatgcacagctgagagtcgaggacacggccgtgtattattgtgcgagagatcccaacggtgaccacattggtgcttttgtatttttgcacggacaagtggtcacgtctcttcagcctccaccaacggccctagtcgttccc

SEQ ID NO: 106200 - DNA, 549 bp, Homo sapiens
  misc_feature: GYAE6OF02GBJMX.36.59.F04.1.454.CMB.1.raw
  modified_base (97)..(97): a, c, t, g, unknown or other
  misc_feature (97)..(97): n is a, c, g, or t
  modified_base (99)..(99): a, c, t, g, unknown or other
  misc_feature (99)..(99): n is a, c, g, or t
  modified_base (246)..(246): a, c, t, g, unknown or other
  misc_feature (246)..(246): n is a, c, g, or t
  modified_base (476)..(476): a, c, t, g, unknown or other
  misc_feature (476)..(476): n is a, c, g, or t
tcagtacgctgtctcacgaccggtgctcgatttagtacacacacttagggatcagggctgaacagagagaactcaccatggagtttgggctgagcgngngtttctaggtggctagtttaaaaggtgtccagtgtgaggtgcaggtgtcggaatctgggggaggcttggtacagcctggggggtccctgagactctcctgtgcagcctctggattcacctttagcagctatgccatgacctgggccnccaggctccagggaaggactggagtgggtctcgtctattagtggaagtggtggttatacgaaactacgcagcctccgtggaacgggccgcttcaccatcctccagagactattccaagagcactctgtatctgacaaatgaacagcctgagtgccgaggacacggccctatattattgtgacgaaatgggtagggggagtgggggctacgtcgtggtcgtttgactacgngggcagggacgccgtggctaccgtctccctcacgcctcccgaccaacgggccctatccggtcccttcccccgg

SEQ ID NO: 106201 - DNA, 582 bp, Homo sapiens
  misc_feature: GYAE6OF02IM6FS.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgcaggctccagggaaggggctggagtgggtctcagcaattaatggtaggggtgagttcaccacattacgcggactccggtggggggccgttcaccatcaccagagacaactccaggacgcacgctatatctgacaaatgcacagcctgagagtcgaggacgacggccgtgtattattgtgcgagagactacccgaacggtcgaaccacgtattggtcgttctttttgttagtttttttcggtaccgtacgggtactaagttcggttaccgtacccgttcttccttccgtacgcccttacccaacccgaacgggtcccctacgttccggttcccccg

SEQ ID NO: 106202 - DNA, 585 bp, Homo sapiens
  misc_feature: GYAE6OF02JCVKB.36.59.F04.1.454.CMB.1.raw
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
tcagtacgctgtctcacgaccggtgctcgatttagtacacacacttagggatcagggctgaacagagagaactcaccatggagtttgggctgagcggtggtcgtttctaggtggctagttttaaaaggtgtccagtgtgaggtgcaggtgtcggaatcgtgggggagcttggttcagccgtgggggtccctgagctctcctgtgcagtctntggattaatctttagtgaacttgcgccaatggactcgtgggtccgccaggctccgaagggagggtctggagtggtcgtcagnaattaagtaggtagggtggtagttcacacaattacgacggacgttccggtcggggccgggttcgtacgacgtcaccagagacacaccagagcacgcatatctnanananacacacgacagagagacgacgacgacgcgtagtattagttgtgagagacgacgtaccgacgtacgacgacgtagttgttgttcgtttcgtttacgtttacgtacgtacggtacgtacgtacgtacgtacgtcgtcgttcgtacgtaccgtaccgtaccgtaccggtaccgtaccgtccgtccg

SEQ ID NO: 106203 - DNA, 643 bp, Homo sapiens
  misc_feature: GYAE6OF02GDJEY.36.59.F04.1.454.CMB.1.raw
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagcggtgtcgtttctaggtggctagtttaaaaggtgtccagtgtgaggtgcaggtgtcggaatcgtgggggaggcttggttcagccgtgggggtccctgagctctcctgtgcagtctctggattaatctttagtgactatgccatgatctgggtccgccaggcctccgagggaagggctgggagtgggtctcgaggcaattaagtgggtaaggggtgtactttcaacccactaacgtttaccgcgggtaaccgttccgggtcgggggggtcccgtttacgacccgtataccacccgaagacggaaccaactaccgaggacgccacggactactactctacgacaaatcggccaacgacgtacctaggacgtaggtaccgaaggaccgaaccgggtccgtaggttatttacggttggtaggaccggaaggtaacgaccgttaccccggaacggttccggaaccgtaccgtaacgtttcgggtgttttacccgg

SEQ ID NO: 106204 - DNA, 559 bp, Homo sapiens
  misc_feature: GYAE6OF02IP64Y.36.59.F04.1.454.CMB.1.raw
  modified_base (301)..(301): a, c, t, g, unknown or other
  misc_feature (301)..(301): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctggggggaggcttggttcagcctggggggtccctgagactctcctgtgcagtctctggattaatctttagtgactatgccatgatctgggtccgccaggctccagggaagggctggagtgggtctcagcaattaatgggtaggggtnattcaccacattacggcggactccggtgggggccgttcaccatcaccagagacaactccaggacgcacgctatatctgacaaatgacacagcctagagagtcgaggacgacggccgtgtattattgtgcgagagactacccgaacggtcgaccactattggtgtcttttgtattttttcggccgtacgggtactaagtcggtctaccgtcttccttcgacgtcctaccaccgaacgggaccctacgtccggttccccg

SEQ ID NO: 106205 - DNA, 511 bp, Homo sapiens
  misc_feature: GYAE6OF02FLX1Q.36.59.F04.1.454.CMB.1.raw
  modified_base (511)..(511): a, c, t, g, unknown or other
  misc_feature (511)..(511): n is a, c, g, or t
tcagtacgctgtctcacgaccggtgctcgatttagtacacacacttagggattggggggtccctgagactctcctgtgcagtctctggattaatctttagtgactatgccatgatctgggtccgccaggctccagggaaggggctggagtgggtctcagcaattaatggtaggggtgattcaccacattacgcggactccgtggggggccggttcaccatcaccagagacaactccaggagcacgctatatctgcaaatgcacagcctgagagtcgaggacacggccgtgtattattgtgcgagagatcccaacggtgaccacattggtgcttttgattttttggccacggggacaatggtcaccgtctcttcagcctccaccaagggcccatcggtcttccccctggccgccctgcctccaggagcacctctgagagcacagcggccctgggctgcctggtcaaggctacttccagacagcgtactgacgcggctggcaaggcgcatagn

SEQ ID NO: 106206 - DNA, 610 bp, Homo sapiens
  misc_feature: GYAE6OF02HLBUL.36.59.F04.1.454.CMB.1.raw
  modified_base (233)..(233): a, c, t, g, unknown or other
  misc_feature (233)..(233): n is a, c, g, or t
tcagtacgctgtctcacgaccggtgctcgatttagtacacacacttagggattgggggagctctgagagaggagcccagccctgggattttcaggtgttttcatttggtgatcagggctgaacagagagaactcaccatggagtttgggctgagcgtggcgttttctgtggctagttttaaaaggtgtccagtgtgaggtgcaggtgtcggaatcgtgggggagcttggttcngcctgggggtccctgagactctcctgtgcagtctctggattaatctttagtgactatgccatgatctgggtccgcaggctcgagggagggcgtggagtgggtctgagcaagttagtgggtagggtgattcaccatacgttacgcggaccgtccgggtggggggtccgtttcgaccgtactccaccgagacgaactaacctcgaaggacgacgacgctaattactcgtacgataaactcgacaacgacgtccctaggacgtacgtacggaacgacgaaccgggtcccgtaggttacttaggttcggtaggcggtaaggacgtaaccgtacccgtaacgggttacgaaccgtaacgtaaggtttcggtagttttaccgg

SEQ ID NO: 106207 - DNA, 558 bp, Homo sapiens
  misc_feature: GYAE6OF02GC7NF.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctggggggaggcttggttcagcctggggggtccctgagactctcctgtgcagtctctggattaatctttagtgactatgccatgatctgggtccgccaggctccgagggaaggggctggagtgggtctcagcaattaagtggtaggggtgattcaccacattacgcggactccggtggggggccgttcaccatcaccagacgacaactccaggacgcacgctatatctgacaaatgacacacgcctgagagtcgaggacacggccgtgtattattgtgcgagagactacccgaacggtcgaccactattggtgttcttttgttattttttggcctagggactaagtggtcaccgttctccttcacgtccctaccacccgtaacggcccctacgtccggttccccg

SEQ ID NO: 106208 - DNA, 611 bp, Homo sapiens
  misc_feature: GYAE6OF02FGMUJ.36.59.F04.1.454.CMB.1.raw
tcagtacgctgtctcacgaccggtgctcgatttagtacacacacttagggagtcagggctgaacagagagaactcaccatggagtttgggctgagctggcttttcttgtggctgttttaaaaggtgtccagtgtgaggtgcaggtgtcggaatctgggggaggcttggttcagcctggggggtccctgagacctctccctgtgcagtctctggattaatctttagtgactatgcccatgatcgtgggtccgccgaggctaccgagggaagggctggaggttgggtctcgagctaaacgttaagtgggtacgggtgtacttaccgaaccaactatttaacgcggaacgttccgggtcggggggtccgttcacccgactccaaccaggacgacaacgtccgaaggtagcacgctatatcgtgacaaatgacaacacgctgagagtacggaggacgacggcgtagtagttattgtgcgagagactaccgaacggtcgacgactacgttcggtcgttcgtttgttagtttttcgaccgtacggtacaagtacggtacctaccgttcctcttcgacgtaccctaccgaaccgtaccggccctacgtccgttccccg

SEQ ID NO: 106209 - DNA, 605 bp, Homo sapiens
  misc_feature: GYAE6OF02GCEHF.36.59.F04.1.454.CMB.1.raw
  modified_base (309)..(309): a, c, t, g, unknown or other
  misc_feature (309)..(309): n is a, c, g, or t
  modified_base (362)..(362): a, c, t, g, unknown or other
  misc_feature (362)..(362): n is a, c, g, or t
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagcgtgcgttttctaggtggctgttttaaaaggtgtccagtgtgaggtgcaggtgtcggaatcgtgggggaggcttggttcagccgtggggggtccctgagactctcctgtgcagtctctggattaatctttagtgactatgcatgatcgtgggtccncaggctccgaggggagggctggagtgggtctcagcaattagtgggtaggggtnattcacacattacgcgactccgggtgggggccgttcaccntccaccagagacaactccgaggacgcacgactatactctnaacgtaatcgacaacctacgcccgtagacgtaacggtaccggaagggaaccacggggtacccgttaggtttactttagtttaggtcggaaccggtaaggacgtaacgtccccggtaaacgggttacgaacccgtaacgtacggtttacggttccgttttacgg

SEQ ID NO: 106210 - DNA, 552 bp, Homo sapiens
  misc_feature: GYAE6OF02FRC0H.36.59.F04.1.454.CMB.1.raw
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
tcagtacgctgtctcacgaccggtgctcgatttagtacacacacttagggagttggggagctctgagagaggagcccagccctgggattttcaggtgttttcatttggtgatcagggctgaacagagagaactcaccatggagtttgggctgagcgtggtcgttttcttaggtggctagttttaaaaggtgtccagtgtgaggtgcaggtgtcggaatcgtgggggagcttggttcagccgtggggggtccctgagctctcctgtgcagtctctggattaatctttagngactatgccatgatcgtgggtccnccaggcctaccgaggggaagggctgggagtgggtctcagcaagttaagtgggtagggtnagttcaccanattcggcgacgtcgggtggggggccgttacacgatcaccgagacgacactccgaggacgcacgctatatctgacaaatgacacagcctgacgagtcgagacgacgcgtagtattactggtgacgagtaagactacccgaaggttcaaccgtactagttcggtgtttaccg

SEQ ID NO: 106211 - DNA, 568 bp, Homo sapiens
  misc_feature: GYAE6OF02GVC8D.36.59.F04.1.454.CMB.1.raw
  modified_base (370)..(370): a, c, t, g, unknown or other
  misc_feature (370)..(370): n is a, c, g, or t
tcagtacgctgtctcacgaccggtgctcgatttagtacacacacttagggatcagggctgaacagagagaactcaccatggagtttgggctgagcgtggcgttttcttaggtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccgagggaaggggctggagtgggtctcagcaattaagtggtagggtgattcaccacattacgcggactccggtggggggccgttcaccatcaccagacgacaactccaggacncacgctatatctgcaaatcgacacagcctgagagtcgaggacgacggccgtgtagttattgtgcgagagactacccgaacggtcgaaccacgtagttggtgttcgttttgttagtttttttcggccgtacgggtactaagtcggtctaccgttctcttcacgtcccttaccgaccgacggccctacgtccggttcccg

SEQ ID NO: 106212 - DNA, 596 bp, Homo sapiens
  misc_feature: GYAE6OF02IFENY.36.59.F04.1.454.CMB.1.raw
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagcgtggcttttctagtggctagttttaaaggtgtccagtgtgaggtgcaggtgtcggaatcgtgggggagcttggttcagccgtgggggtccctgagactctcctgtgcagtctctggattaatctttagtgactatgccatgatcgtgggtccgccgaggctccgaggggagggctgggagtgggtctgagacaattagtgggtaggggtnattcacacagttacgcggacgtccgggtgggggtccgttcacctatcaccagacgacactcaggancacgctatatcngacaaatcgacacgacgccgtagaagtacggtacggaacggaccgtaccgggccgttaggttactttaagttggtacggtaccggaaggtacgtaaccgttaccccggaacgggtacgtaacccgtaagttacgtttcgggttacgttttacgg

SEQ ID NO: 106213 - DNA, 557 bp, Homo sapiens
  misc_feature: GYAE6OF02I3GTQ.36.59.F04.1.454.CMB.1.raw
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagctggcttttcttgtggctgttttaaaaggtgtccagtgtgaggtgcaggtgtcggaatctgggggaggcttggttcagcctggggggtccctgagactctcctgtgcagcgtctggattcaccttcagtagctatggcatgcacgtgggtccgccaggctccgaggcgaaggggctgggagtggggtggcagttatagtggtatgatggaaagtaataaatactatgacagctccgtagaacgggccattcacatctccagagacaattcaaagaacacgctagtatgtcgacaaatcgaaacacgcctaggacgacggaccgaaggacgtacggcgttacggttagttaacttaccgtggttggacggtaaggaccgacccggtccttccgtaccgtaccccg

SEQ ID NO: 106214 - DNA, 872 bp, Homo sapiens
  misc_feature: GYAE6OF02IW6ZZ.36.59.F04.1.454.CMB.1.raw
  modified_base (319)..(319): a, c, t, g, unknown or other
  misc_feature (319)..(319): n is a, c, g, or t
tcagtacgctgtctcacgaccggtgctcgatttagtacacacacttagggatcagggctgaacagagagaactcaccatggagtttgggctgagcgtggtcgttttcttaggtggctagtttttaaaaggtgtccagtgtgaggtgcaggtgtcggaatcgtgggggaggcttggttcagccgtgggggtccctgagactctcctgtgcagtctctggattaatctttagtgactatgcctatgatcgtcgggtccgccgaggcctccgaggggaagggctgggaggtgggtctcagacaatttaagtgggtaggggtntagttcactactagttacggacggacctccgggtggggggtcccgttcaccgatccaaccgaagacgtaaccaaaccgtaccgaacgggaacgaccgaacgtactttaaacgtaacttcctacggtaaacctaaaaagtcgaacccaaccgtaaccggtacccgtaggaacggtaacgggttacgggtaacgggaaccggacccggggtacccgggacggtttttttttttttttttttttttttttaacggtaagttttacggttacgggtacgggtaaacgggaaacggtaaaccgttaaccccggtaaacccgggttaaccggaacccgtaaccgttaacggttttagggtttacggttttacgttttttacggtttttaacggttttttttacgggttacccggttaaccggggttaaccgttaaacggtttaccgggttaccggttacccggttacccgtttacccgtttaccgtaccgttaccccgttaccccgtaaccccggtaacccgggtacccccgttacccggttacccggtttacccccgg

SEQ ID NO: 106215 - DNA, 586 bp, Homo sapiens
  misc_feature: GYAE6OF02G7X9L.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccagggaaggggctggagtgggtctcagcaattaatggtaggggtgattcaccacattacgcggactccggtgggggccgttcaccatcaccagacgacaactccaggacgcacgctatatctgacaaatgacacacgcctgagagtcgaggacgacggccgtgtattattgtgcgagagactacccgaacggtcgaaccactagttgggtcgttcgtttttagttagttttttcgggaccgtaccgggtacgtaagttcggtcctacccgttccttctttccgacgtcccctaccgacccgtaacgggtcccctacgttcccggttccccg

SEQ ID NO: 106216 - DNA, 638 bp, Homo sapiens
  misc_feature: GYAE6OF02G0KLI.36.59.F04.1.454.CMB.1.raw
  modified_base (233)..(233): a, c, t, g, unknown or other
  misc_feature (233)..(233): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
tcagtacgctgtctcacgaccggtgctcgatttagtacacacacttagggatcgagggctgaacagagagaactcaccatggagtttgggctgagcgtggtcgttttcttaggtggctagttttaaaaggtgtccagtgtgaggtgcaggtgtcggaatctggggggaggcttggttcagccgtggggggtccctgagactctcctgtgcagtctctggattaactctttagngactatgccatgatctgggtccgccaggctccagggaaggggctggagtgggtctcagcaattatggtaggggtgattcaccacattaccgcggactccggtgggggggccgttcaccntcaccagagaccaactcagggancacgctatatctagaccaaatcgactacacgcctagacggacggtacggagggaccgacgggtccgttaggttacttagttggtggccgtaagacgtactaccccgtaacgggtacgtaacccgaactacgtttgggtacttcgtttttcggttactttttttagggacccgtaacgggtaaagttcggtaccgtaccggttacttcgttaccgacggtcctaccgaaccgaccgggtcccacggttccggtccttcccccgg

SEQ ID NO: 106217 - DNA, 576 bp, Homo sapiens
  misc_feature: GYAE6OF02JF443.36.59.F04.1.454.CMB.1.raw
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (369)..(369): a, c, t, g, unknown or other
  misc_feature (369)..(369): n is a, c, g, or t
tcagtacgctgtctcacgaccggtgctcgatttagtacacacacttagggatcagggctgaacagagagaactcaccatggagtttgggctgagctggcttttcttgtggctgttttaaaggtgtccagtgtgaggtgcaggtgtcggaatctgggggagcttggttcagcctggggggtccctgagactctcctgtgcagtctctggattaatctttagtgactatgccatgatctgggtccaccaggctccgaggggaaggggctggagtgggtctcgagcaattaatggtaggggtnattcaccnattcgngactcggtgggggccgttcacntcaccagagacactccaggagcacgctaagtanctagacaaatcgacacacgcctgagagtcgaggacacggtcgtgtattattgtgcgagagactaccgaacggtgaccgactacgttggtgttcgttttgttagttttttcggtaccgtaccgggtacgtaagtacggtcctacccgttcttccgttctaccgtccctcccgtacccgaccgggtaccctacgttcccggttaccccg

SEQ ID NO: 106218 - DNA, 547 bp, Homo sapiens
  misc_feature: GYAE6OF02GHYW6.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccagggaaggggctggagtgggtctcagcaattaatgggtagggtgattcaccacattacgcggactccggtggggggccgttcaccatcaccagagacaactccaggagcacgctatatctgcaaatgcacagcctgagagtcgaggacacggccgtgtattattgtgcgagagatcccaacggtcgaccacagttggtgtcttttgtagttttttcggccgtacgggtacaagtggtccaccgttcctcttcacgtccctccaccgaacgggccctacgtccggttccccg

SEQ ID NO: 106219 - DNA, 571 bp, Homo sapiens
  misc_feature: GYAE6OF02JFG81.36.59.F04.1.454.CMB.1.raw
  modified_base (246)..(246): a, c, t, g, unknown or other
  misc_feature (246)..(246): n is a, c, g, or t
  modified_base (366)..(366): a, c, t, g, unknown or other
  misc_feature (366)..(366): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggagcttggttcagcctggggggtccctgagactctcctgtgcagtctctggattaatctttagtgactatgccatgatctgggtccnccaggctccagggaagggctggagtgggtctcagcaattaagtgggtagggtgattcaccacattacgcggactccggtgggggccgttcaccatccaccagacgacaactccgaggacncacgctatatctagacaaatcgacacacgcctgagagtcgaggacgacggcgtgtattagttgtgcgagagactacccgaacggtcgaccacgtagttggtcgttcgttttgttacgttttttcggaccgtacgggactagtcggtcctaccgttccttcttcacgtccctacccgacccgaccggccctacgtccggttccccg

SEQ ID NO: 106220 - DNA, 593 bp, Homo sapiens
  misc_feature: GYAE6OF02F639B.36.59.F04.1.454.CMB.1.raw
  modified_base (246)..(246): a, c, t, g, unknown or other
  misc_feature (246)..(246): n is a, c, g, or t
tcagtacgctgtctcacgaccggtgctcgatttagtacacacacttagggatcagggctgaacagagagaactcaccatggagtttgggctgagctggcttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccnccaggcctccgaggggaaggggctggagtgggtctcagcaattaatgggtaggggtgattcaccacattaccggcggactccggtggggggccgttcaccatcaccagagacaactccgaggagcacgctatatctgacaaatgacacagcctgagagtcgaggacacgggccgtgtattattgtgcgagagtactacccgaacggtcgaccacgtagtttggttgttcgttttgttagtttttttcggacccgttacgggtacgtaagttcggtacctaacccgttcttccttcgtaccgtcccttacccacccgaaccgggcccctacgtcccggtttacccccg

SEQ ID NO: 106221 - DNA, 595 bp, Homo sapiens
  misc_feature: GYAE6OF02FJFCS.36.59.F04.1.454.CMB.1.raw
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
tcagtacgctgtctcacgaccggtgctcgatttagtacacacacttagggatcagggctgaacagagagaactcaccatggagtttgggctgagcgtgcgtttctaggtggctagttttaaaaggtgtccagtgtgaggtgcaggtgtcggaatctgggggaggcttggttcagcctggggggtccctgagactctcctgtgcagtctctggattaatctttagtgacttatgccatgatctgggtccgccaggctccgagggaaggggctggagtgggctcagcaaattaagtggtaggggtgattcaccaatattacgcggtactccgggtggggggccgttcaacctntcaccgagagtacaaactccaggacncacgctagatctgacaaatgcacagctagngagtcgaggacgacgggccgtgtattagttgtgtcgaagagtacgtaccctaaacggtacgtaacccgactaagttggttcgttcgttttgttagtttttttcgaccgtacggtacgagttcggtacgtaccggttccttcttccgtacgtcctacccgaccgtacggaccctacgtcggttcccccg

SEQ ID NO: 106222 - DNA, 712 bp, Homo sapiens
  misc_feature: GYAE6OF02JKRXZ.36.59.F04.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
tcagtacgctgtctcacgaccggtgctcgatttagtacacacacttagggatcagggctgaacagagagaactcaccatggagtttgggctgagcgtggcgttttcttgtggctgttttaaaaggtgtcagtgtgaggtgcaggtgtcggaatcgtgggggaggctcggttcagccgtggggggtccctgagactctcctgtgcngtctctggattaatctttagtgactatgcctatgatctgggtccnccgagctccgagggagggtctgggagtgggtcacgagctaagttaagtgggtaaggggttntactaccacgacgtacgtaccggcggtacgtccggggtcgggggtccgtaccaccgtactaccgaaccgaaggaacgaaccgtaaccgccggacggacgaccgtacgtacttaacgtactcgtagaactaaagtcgacgacgacgtaccgtaggaacggacggtacggacgaccggacggtccgttagttacgttaggttagtcggtacgagtacgtaaccgtaccggtaacggtaccgtacctacgtacgttcggttcgtttacgttttacgtttacggtttttacggtaccgttaacggtacgttacggtacggttaccgtaccgttccgttaccgttaccgtaccgtacccgtacccgtaacccggtaccggtacccggtaccgttcccggttcccgg

SEQ ID NO: 106223 - DNA, 626 bp, Homo sapiens
  misc_feature: GYAE6OF02F5GPD.36.59.F04.1.454.CMB.1.raw
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
tcagtacgctgtctcacgaccggtgctcgatttagtacacacacttagggatcagggctgaacagagagaactcaccatggagtttgggctgagcgtgtgttttctaggtggctagttttaaaaggtgtcagtgtgaggtgcaggtgtcggaatctggggggaggcttggttcagcctggggggtccctgagactctcctgtgcagtctctggattaatctttagtgactatgccatgatcgtgggtccgccaggctccgagggaaggggctgggagtggggtctcgagtcaattaagtgggtaggggtgtattcaaccgacagttaccggcggacctccggnggggggcccgttcaaccgntcaccagagacaactcaaggngctagctatatcngacaaatgacctacagcctgaacgtagaggaaggacgacggaccggtagttattagttagtgtacgaagagtacgtacccgaacggttacgaaccacgtaagtttggtgtttacgttttgttacgttttttacggaccgtacgggactaagttcggtaccgtaaccggttccttactttacgacgtcccgtacccgaacccggtaacggccctaaccgttccgttccccg

SEQ ID NO: 106224 - DNA, 568 bp, Homo sapiens
  misc_feature: GYAE6OF02G2IQJ.36.59.F04.1.454.CMB.1.raw
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
tcagtacgctgtctcacgaccggtgctcgatttagtacacacacttagggatcagggctgaacagagagaactcaccatggagtttgggctgagcgtggcttttcttggtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccgagggaaggggctggagtggggtctcgagcaattaatgggtagggtgattcaccanattacgcggactccggtgggggccgttcaccatcaccagagacaactccaggagcacgctatatcngacaaatgcacagcctgagagtcgaggacgacggccgttgtattagttgtgcgagagactacccgaacggtcgaccacagttggtgttcgttttgttacgttttttggccgtacggtacgtaagtcggtctaccgttacgttccgttcctacgtccctccacccgaacggtccctacgtccgttccccg

SEQ ID NO: 106225 - DNA, 745 bp, Homo sapiens
  misc_feature: GYAE6OF02IHA1T.36.59.F04.1.454.CMB.1.raw
  modified_base (251)..(251): a, c, t, g, unknown or other
  misc_feature (251)..(251): n is a, c, g, or t
  modified_base (316)..(316): a, c, t, g, unknown or other
  misc_feature (316)..(316): n is a, c, g, or t
tcagtacgctgtctcacgaccggtgctcgatttagtacacacacttagggatcagggctgaacagagagaactcaccatggagtttgggctgagcgtgtcgttttctaggtggctagttttaaaaggtgtccagtgtgaggtgcaggtgtcggaatcgtgggggagcttggttcagccgtgggggtccctgagactctcctgtgcagtctctggattaatctttagtgactatgccatgatcgtgggtccncaggctaccgaggggaagggctggagttgggtctcgagctaaagtttaagtggggtaggggttanactttaccaacctaactaacgttaccggccggtaaccgtttcccggggtgggggggtaccccgtttaccacccgtaagttacccgaacccgaaggaacgaacctaaacccgtccgaagggacgtccaacggtctaaatactcgtagacctaaaattcgaccaacgacgtcctaggacgtagtacggaggaaccgacggtccgtagttacttagttggtggtcggggtaaggggggttattgggtgggtacggaccgtaaccgttaccgacgtcgtacgtaccgttaaacccgtaacgttcggttacccgacccgggttacggggacccggtaaccggggtaccccggttacggttacccgtaacccggttccctaccgtcccgtaccgtccccgtaccccgaacccggtacccgggtaccctaacccgg

SEQ ID NO: 106226 - DNA, 656 bp, Homo sapiens
  misc_feature: GYAE6OF02JIEI7.36.59.F04.1.454.CMB.1.raw
  modified_base (307)..(307): a, c, t, g, unknown or other
  misc_feature (307)..(307): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtggggggaggcttggttcagccgtggggggtccctgagctctctgtgcagtctctggattaatctttagtgactatgccatgatcgtggtccgcaggctccgagggagggctggaggtgggtctcgagctaagttaagtgggtaagggggtntactccacctacgtacgtacggccggtaccggtccggggtcgggggtcccgttacaccgactaccgacgaagacgactaacgtacgagcgacgacgtctatactctagaactaatcgacacgacgaccgtagacgacggtacggacggaccggacggtacgttagttagtttagttggtacgacggacgtacgtaccgtacccgaacggtaccaccgtaagtcgttcggttcgtttcgttttagtttacgttttacggaccggtacgtacgtacgttcgtaccgttaccgttctccgttccgaccgtacccgtacccgaccggtacggtccctaccggttcccgtcccg

SEQ ID NO: 106227 - DNA, 670 bp, Homo sapiens
  misc_feature: GYAE6OF02F2ZAT.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaggtgtccagtgtgaggtgcagttgttggattcgtggggggaggcttggtacaggccgggggggtccctgagactctcctgtgcagcttcaggattcagtctttagcagctacgccatgagcgtgggtccgccgaggcctccgaggggaagggactggagtgggtctcgaggtagttgggtggctaggtggtaggacgaccacatacacgcagactccggtagaacgggtccgttacacctatcctccaagacgaactaacttaccgaaacgaacctacccgtagttacctactacgaacctaaaatacgaaacctaaccgtagaacgtacggacccggaacggaccaaccgggtacccttaataacgttaacgtacgtaaacgtaaaacgttcggacccgttaacggattaagtacgtaactaacgttagtttacgggtacgttacggttaacgttcgtacttccgtcggtcggggtcccgtcggcccgtaccggtggtacctaccgttcgtccttcctacctacgccctaccgacccgacggtacccg

SEQ ID NO: 106228 - DNA, 559 bp, Homo sapiens
  misc_feature: GYAE6OF02GCZ6C.36.59.F04.1.454.CMB.1.raw
  modified_base (432)..(432): a, c, t, g, unknown or other
  misc_feature (432)..(432): n is a, c, g, or t
  modified_base (454)..(454): a, c, t, g, unknown or other
  misc_feature (454)..(454): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccagggaaggggctggagtgggtctcagcaattaatggtaggggtgattcaccacattacgcggactccggtggggggccgttcaccatcaccagacgacaactccaggagcacgctatatctgacaaatcgcacacgcctagagagtcggaggacgacggaccgtgtattattgtgngagagatccgaacgtcgaccanagtttggtgttcgttttgttagttttttgggtcctacgggtactaagtcggtcaccgttcttccgtttcacgtcctccaccgaacggccctacgtccggttcccc

SEQ ID NO: 106229 - DNA, 700 bp, Homo sapiens
  misc_feature: GYAE6OF02GN11T.36.59.F04.1.454.CMB.1.raw
  modified_base (313)..(313): a, c, t, g, unknown or other
  misc_feature (313)..(313): n is a, c, g, or t
tcagtacgctgtctcacgaccggtgctcgatttagtacacacacttagggatcagggctgaacagagagaactcaccatggagtttgggctgagctggcttttcttgtggctgttttaaaaggtgtccagtgtgaggtgcaggtgtcggaatcgtggggggaggcttggttcagccgtggggggtccctgagactctcctgtgcagtctctggattaattctttagtgactatgccatgatcgtcgggtccgccgaggctccgaggggaaggggctgggaggtgggtctcgagctaattagtgggtaggggtnattcacatattacggcgacgtccggtcgggggccgttcacatcaccgagacacaactccgaggacgacacgactatatctagaactaaagtcgaccacgacgccgtaggagacggtacggacggaaccgacgggtaccggttagttaacgtttacgtttcggtacggtacggtaacgaacgtaccgtacccggtaaacgggtaccgaacccgtacgttacggtttagggttacgtttacgtttttacggttttaacgttttttcgggaccgttaaccgggtacgttaacggttacggttaccgttacccggttccgttccgttaccgtaccgttaccctacccgaacccggtaacccggtacccgtaccggttcccggttcccccgg

SEQ ID NO: 106230 - DNA, 540 bp, Homo sapiens
  misc_feature: GYAE6OF02FMKG6.36.59.F04.1.454.CMB.1.raw
  modified_base (363)..(363): a, c, t, g, unknown or other
  misc_feature (363)..(363): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccagggaaggggctggagtgggtctcagcaattaatggtaggggtgattcaccacattacgcggactccgtggggggccgttcaccatcaccagagacaactccaggancacgctatatctgcaaatgacacagcctgagagtcgaggacacgggccgtgtattattgtgcgagagatcccaacggtcgaccacagttcggtgtattttgtattttttggccgtacgggactaagtggtcaccgtctcttcagtcctccaccgaacggccctacgtccgttccccg

SEQ ID NO: 106231 - DNA, 670 bp, Homo sapiens
  misc_feature: GYAE6OF02GLO0H.36.59.F04.1.454.CMB.1.raw
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagctggctttttcttgtggctgttttaaaaggtgtccagtgtgaggtgcaggtgtcggaatcgtgggggaggcttggttcagccgtggggggtccctgagactctcctgtgcagtctctggattaatctttagtgactatgccatgatcgtgggtccgccgaggcctccgaggggaaggggcgtgggaggtgggtctcagcaagttatgggtaggggtgacttcaccactatacgcggtacgtccgggtgggggtccgttcaccgactcaccgacgacgaacaacctaccgaggacgacgacgacttatactctagactaaatcgacaacgacgtacctaggaaggtacgtacggaacgggaaccgaaccggggtacccgttaggttaacgttttaggttttacgggttacggtaaccggtaaggtaaacggtacccgttaacccccggtaaacggggttacccggtaaaccccgtaaaccggttaacggttttacggggttaccggttttttaccggg

SEQ ID NO: 106232 - DNA, 572 bp, Homo sapiens
  misc_feature: GYAE6OF02GZ6NQ.36.59.F04.1.454.CMB.1.raw
  modified_base (369)..(369): a, c, t, g, unknown or other
  misc_feature (369)..(369): n is a, c, g, or t
  modified_base (425)..(425): a, c, t, g, unknown or other
  misc_feature (425)..(425): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagccgtggggggtccctgagactctcctgtgcagtctctggattaatctttagtgactatgccatgatctgggtccgccaggcctccgaggggaaggggctggagtgggtctcagcaattaagtggtaggggtgattcaccacattacgcggactccggtgggggccgttcacatcaccagagacaactccgaggacncacgctatatctgacaaatgacacagcctgagagtcgaggacgacggcgtgtattnttgtgcgagagactacccgaacggtacgaccacgagttgtcgtcgttttgttagttttttcggaccgtacgggtacgtaacgtcggtcctaccgttcgtccttccgtacgtcctccgaccgaaccggaccctacgtccgttcccccg

SEQ ID NO: 106233 - DNA, 581 bp, Homo sapiens
  misc_feature: GYAE6OF02G89Y6.36.59.F04.1.454.CMB.1.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (344)..(344): a, c, t, g, unknown or other
  misc_feature (344)..(344): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctggggggaggcttggttcagcctggggggtccctgagactctcctgtgcagcctctggattccccttnagtgactactggatgcactgggtccncaagctccgagggaagggctggtgtgggtctcacgtattagtagtgatgggagttacacaactaatgtggagtccggtggagggccgattccaccntctccagagacaacgccaaagaaccacgctgtatctgacaaatgaactgtctgagagccggaggacacggctgtgtattattgtgtactaacgtttcggtatttaggttggaccggacgcgacgaaggtcggggaccgacgggaaccctgggtacctacccgtctccctcgacgccctaccgaaccgaaccggcccacgttcccggttcccttcccccgtcggtcccgcccgtccgg

SEQ ID NO: 106234 - DNA, 807 bp, Homo sapiens
  misc_feature: GYAE6OF02IBMHF.36.59.F04.1.454.CMB.1.raw
  modified_base (226)..(226): a, c, t, g, unknown or other
  misc_feature (226)..(226): n is a, c, g, or t
tcagtacgctgtctcacgaccggtgctcgatttagtacacacacttagggatcagggctgaacagagagaactcaccatggagtttgggctgagcgtggcgtttttctggtggctgttttaaaaggtgtccagtgtgaggtgcaggtgtcggaatctgggggagcttggttcagcctggggggtccctgagactctcctgtgcagtctctggattaatcttttagngactatgccatgatcgtgggtccgccaggcttccgaggggaaggggctagggaggtggggtcctacgacgactaaattaagtaggggtagggtagagtttccacctactacgttacggccggtaccgttccggggtggggggtcccgtttacacctagtccaaccgagacgaacaccgtcgaacggacgacacggtactaagttactcgtacgactaaatcggacccaacgacgtacccgtaggaacgtacggtacgggaacggtaaccgaccggggtaccgttacggtttaacttttacgtttaggtcggtaccggaggtaacgtaaccgttaaccccgtaaccgggtacccgtaaccgtaaccgttaaggtttcgggtttacgtttaccgttttttttaggttttaacggtttttttttacccgggacccgggttaaccgggttaaccgttaacggtttacgggttacccgttaacccgggtttacctttcccggttttacccaccggttaccccctaacccggtaacccccggttaaccgggtaccccttaacccggttccccggttttcccccccgg

SEQ ID NO: 106235 - DNA, 686 bp, Homo sapiens
  misc_feature: GYAE6OF02GI3AK.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccgagctccgagggagggctggagtggtctacgagactaattagtggggtagggtgtattccaccactagttaccggcggtaccgtccgggtggggggtcccgttcaccactccaccagacgacaacgtccgaaggacacacgcttaatactcgtagactaaagtcgaccaacgacgccgtaggagacggtacggaacggaccgaccgggtaccgttagttatttacggttggtacggacggtaagacgtaccgtacccgaacggtacgacccgtaacgtacggttggttacgtttacgtttttgttttacgttttttcgggaccgtaacgggtacgttacggttccggtaccgtacccgtttccttaccgttaccgtaccgtacccctacccggaacccggtacccgggtaccccttacggttccccggtttcccccg

SEQ ID NO: 106236 - DNA, 711 bp, Homo sapiens
  misc_feature: GYAE6OF02GK2G6.36.59.F04.1.454.CMB.1.raw
  modified_base (127)..(127): a, c, t, g, unknown or other
  misc_feature (127)..(127): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (420)..(420): a, c, t, g, unknown or other
  misc_feature (420)..(420): n is a, c, g, or t
  modified_base (449)..(449): a, c, t, g, unknown or other
  misc_feature (449)..(449): n is a, c, g, or t
tcagtacgctgtctcacgaccggtgctcgatttagtacacacacttagggatcagggctgaacagagagaactcaccatggagtttgggctgagcggtgtcgtttctaggtggctagttttaaaggntcagtgtgaggtgcaggtgtcggaatcgtgggggagcttggttcagccgtgggggtccctgagactctctgtgcagtctntggtattaattctttagtntactatgccatgatcgtcgggtcccgccgaggtccaccggaagggggtaaggggcttgggaggttgggtctaccagtactaaagtttaggtaggggtaggggtctacttacaaccgtacttagttaccggcggtaccgtccggggtcgggggtcctacgacctacgtacaaccaggtacacaaaccgcaaggcnctaacgtctatactactacaactaaagtnacaacgcgtaccgtagaagtacgacggaacggacggacggtacgtagttaagttacgttgtcggtagtacgactaccgtaccgacggtacgaacctacgttacgttggttacgtttcgtttttacgttttaacggtttttcggaccgttaacgggtacttaacggtaccggtaccgttaaccgttccgttaacgttccgttacgtaccccttacccgaaaccgtaacccgggtccccttaccggttccccggtttccccccg

SEQ ID NO: 106237 - DNA, 740 bp, Homo sapiens
  misc_feature: GYAE6OF02ILFXJ.36.59.F04.1.454.CMB.1.raw
  modified_base (175)..(175): a, c, t, g, unknown or other
  misc_feature (175)..(175): n is a, c, g, or t
  modified_base (231)..(231): a, c, t, g, unknown or other
  misc_feature (231)..(231): n is a, c, g, or t
tcagtacgctgtctcacgaccggtgctcgatttagtacacacacttagggatcagggctgaacagagagaactcaccatggagtttgggctgagcgtgcgttttctaggtggctagttttaaaaggtgtccagtgtgaggtgcaggtgtcggaatctggggggaggcttggttcngccgttggggggtccctgagactctcctgtgcagtctctggatttaatctttagtnactatgccatgatcgtcgggtcccgcaggcctaccgaggggaacggggcgtggtaaggtgggtcctcagacgtaattaaggtgggtaggggtgtagttaccgacctaagtacgttacggtccggacgttccgggtcggggggtccgttaccaccgactaccgaccgaagacgacaaccgtacgaaggacgacacgtactagtaactcgttacgaacgtaaaatcggtaccaaccgacgtacccgttaaggacggtacgggtacggaaacggtaaccggaaccgggtacccggttaggttaagtttagttacggtgaccggttaggacgtaacggtacccgtaaacgggtacgaaccgtaacgttagtttcggtacgttcttttaggttttacgtttttacggtaccgtaacggtagtaacgttcgggtaccttccgttaccgttccgttacgtacccgtacccgtacccctaaccggtaccggtaccccgtaggtcccgttacccccgg

SEQ ID NO: 106238 - DNA, 608 bp, Homo sapiens
  misc_feature: GYAE6OF02FZHBZ.36.59.F04.1.454.CMB.1.raw
  modified_base (249)..(249): a, c, t, g, unknown or other
  misc_feature (249)..(249): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaagtgcagttgttggattctggggggaggcttggtacaggccgggggggtccctgagactctcctgtgcagcttcaggattcagctttagcagctacgccatgagctgggtccnccaggctccgagggaggactggagtgggtctcgaggtattggtggccaggtggtgagaccacatactacgcagacctccgtgaacgggccggttcaccatctccagagacaattaccaagaaccaccctgtctctcgactaaactagaacaacctagagaacgccgaaggaccgaccggacccttataacttacgtagttaacgaaagttcggaccgtacggatatacgtactactagttggacgttcggttacgttacgtagttcgtcgtcggggtaccgtcggaccgtacccgtcggtacctaccgttgttccctcccgttaccgaccgtccctacccgtaccgaccggtacccccg

SEQ ID NO: 106239 - DNA, 785 bp, Homo sapiens
  misc_feature: GYAE6OF02IXJ2E.36.59.F04.1.454.CMB.1.raw
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtggggggaggcttggttcagccgtggggggtccctgagactctcctgtgcagtctctggtattaattctttagtgactatcgccatgatcgtcgggtcccgccgacggcctccgaggggaaggggtcgtgggaggttgggtctcgagactaaagtttaagtggggttaggggtgtacttaccgaaccactaacgttaccggacggtaccgtccggggtcgggggggtcccgttccgacctactccaccgaaggacgaaccaaccgtaccgaagggacgaccgaacgtacttaactacgtactcggaacctaaatcgaccacgacgtccgtaggagaacggtcggaacggaaccggaccgggtaccggttagttaagtttaggttcggtaggcggtaacggtaacgtaccctaacccgaacgggttccggaaccctaacgttacgtttgggttacgttttcgttttttacggttttacgtttttttaccgggaccgttaacgggtaccgttaacgttcgggttaaccccgttacccggtttccgtttaccgtttacccgacccggttaccccttaccccgaaacccggtaacccggggtaccccttaccgggttccccggtttaccccccg

SEQ ID NO: 106240 - DNA, 733 bp, Homo sapiens
  misc_feature: GYAE6OF02GINBB.36.59.F04.1.454.CMB.1.raw
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagcgtgtcgttttctaggtggctagttttaaaaggtgtccagtgtgaggtgcaggtgtcggaatcgtgggggaggcttggttcagccgtggggggtccctgacgactctcctgtgcgagttctcgtggtaatttaatcgttttagtgaacttatgacctagttgactcgtcgggtcccgccgaggtccgtaccgagggggtaacgggtcgtagggaggttcgggtcctcgagtactaaagtttaaggtggggttaggggtagtacgttaccgaacccgtaacgtacgttaccggacggtaccggttcccggggtgggggggtccccgtttacgaacccgtacgttacccgaaccgaacggaacgtaaaccaaacccgtaccgaacgggaacgaccgaaccgtacgttaacgtactaccttaggaacctaaagtccgaacgtaccgaccggtccgtagacggtaaccgtacggtaacggaaccgacgggttccgtaagttacttaggttcggtcggacgaaggtacgtaacccgttacccggaaacggttcgaacccgtaacgtaggttcggtcggttttacg

SEQ ID NO: 106241 - DNA, 874 bp, Homo sapiens
  misc_feature: GYAE6OF02HUIOP.36.59.F04.1.454.CMB.1.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (331)..(331): a, c, t, g, unknown or other
  misc_feature (331)..(331): n is a, c, g, or t
tcagtacgctgtctcacgaccggtgctcgatttagtacacacacttagggatcagggctgaacagagagaactcaccatggagtttgggctgagctggctttttcttgtggcttagttttaaaaggtgtccagtgtgaggtgcaggtgtcggaatcgtggggggagcttggttcaggccgtgggggtccctgagactctcctgtgcagtctctggattaatctttagtnacttatgcctatgatcgtgggtcccncgaggcctaccgaggggaaggggtccgtggaggtggggtcctacgagtactaaagttaagtcggggttaaggggtntacttaccgaaccacgtaacgtttaccggaccggtaccgttcccggggtacggggggggttccccgttaccaacccgtagtacccgaaccgaacggaaacggaaaccctaacccgttaccgaagggaaccgaccgtaaacccggtcttaaactacgtaccgttacggaacctaaaagtcggaacccgtaacgtaccgaacccgtagggaaacgtacggtaccgggaacggtaaccggacccgggggttaccgtttagttaacgtttagtttacgggtacggacggtaacggtaagaccccgttaacccggaaaccggggttccaaaacccgtacgtttacggtttcgggttacggttttacggtttttttacggtttttacggttttttccggaaccccgggttaacgggttaccttaacgggttacgggtaccccgttacccggttaccgttaaccgtttccgaacccgttaccccgtaaccccggtaaccccgggtaaccccgggttccccgttaccggttaccccggtttttcccccccg

SEQ ID NO: 106242 - DNA, 750 bp, Homo sapiens
  misc_feature: GYAE6OF02IXAKK.36.59.F04.1.454.CMB.1.raw
  modified_base (311)..(311): a, c, t, g, unknown or other
  misc_feature (311)..(311): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctggggggaggcttggttcagccgtggggggtccctgagactctcctgtgcagtctctggattaatctttagtgactatgccatgatcgtgggtccgccaggctccgagggaggggcgtggaggtgggtcctcgagacaatttaagtgggtaggggtnattccaccactattaccggcggtaccgtccgggtcgggggggcccgttaccgacctacgtaccaccgaagacgaaccgtaactacccgaagggaacgccaccgactaatactactagaacctaaatgaccacacgaccgtacggaagacggtacggacgggaccgaccgggtccgttacggttagttttaacgttggtacgcggtaaggacgtaccgtaccccggtaaacgggtaccgtaaaccccgacgttaacgtttagggttccgtttacgttttttacggttttaacggttttttttacggggacccgttaaccggggtaaccttaaggtttcccggttaccgtacccgtttccgttcccgtttaccgaccgttaccccttaccccggtaacccgaacccgggtccccgtaccggttcccggtttacccccccgg

SEQ ID NO: 106243 - DNA, 822 bp, Homo sapiens
  misc_feature: GYAE6OF02IHT22.36.59.F04.1.454.CMB.1.raw
  modified_base (142)..(142): a, c, t, g, unknown or other
  misc_feature (142)..(142): n is a, c, g, or t
  modified_base (774)..(774): a, c, t, g, unknown or other
  misc_feature (774)..(774): n is a, c, g, or t
tcagtacgctgtctcacgaccggtgctcgatttagtacacacacttagggtagttcgaggctgaacgagaggagaacctcaccctagtggtacgtttagggcttgagtcgtggtcgtttctgtggtctagtttaaaacggtntcgagtgtgaggtgtcgtaggttcggtcgtagtcggtggggtaggtcttttcggtcacggtccggtcggggttaccttaaggcgtacctccgttcgtaggtggcgtaacgttcgtcggtggtagttaacgttcggtttagggcgtactacggtaccgctaacgttggacgtttcccggcgggtaccgccgacgggttcctaccgggtaggggtacgggtaccgtggtacgggttgggtaccgttccgtaacggttacgttaaacgttaagggttacgggtaagggttacgttacgtaccgtacctaacggttacggttaccgggcgtacccggttacgggtcccgggggtcttaaccggcgtacgtaccgacggtacgacggtacaacgttaccggaggtacgtcacggtctaacgtatacgtacgtaacgtaacctagtaccgtacgacgtccgtaacgacggtacggacggtacggtaccggtaccggtaccgttacgtacgttacgttacggtacgtactaacggtaacacgtacgtaacgtcgtaacccgtatacgttacggacgtttcgttacggttacgttccggaacgtaggtaccgtacgtaccgtctacccgttgtacccgtntaacccgtcgtaccgtaaccggtacggaaccgtcgtaccgttccccgg

SEQ ID NO: 106244 - DNA, 583 bp, Homo sapiens
  misc_feature: GYAE6OF02H3JBG.36.59.F04.1.454.CMB.1.raw
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctggggggaggcttggttcagcctggggggtccctgagactctcctgtgcagtctctggattaatctttagtgactatgccatgatctgggtccgccaggctccgagggaaggggctggaggtgggtctcgagactaattaagtgggtaggggtnattcaaccatattacggcggtactccgggtgggggtccgttcaccatcaccagagacacnccaggancacgctaatatctgacaaagtcacacagacctgagagtacgacggacgacggtacgtgtatttattagtgcgaagacgactacccaacggtcgaaccgtactagttcggtgttcgttttgttacgttttttcgacgttacggactaagtcggtactaccgtcttctactacgtcctacccaccgaacggaccctacgtccgttccccg

SEQ ID NO: 106245 - DNA, 664 bp, Homo sapiens
  misc_feature: GYAE6OF02JF6JB.36.59.F04.1.454.CMB.1.raw
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccgaggggaaggggctggaggtgggtctcagcaattaagngggtagggtgattccacacagttaccggcggacgtccggtggggggccgttcaccntcaccagagacactccaggacncacgctatancgtnacaaatgacacgacgcctacggaagacggtcggaacggacgaccgggtcgttacgttacgtttagttgttacggacgaaggacgtaaccgtacccgaaacgggtacgtaacccgtacgtagtttacgggttagtttcgtttttacgtttacgtttttttccggaccgtaaccgggtactaacggttcggtaccgtacccggttcttccgttccgtaccgttccccgtacccgtaaccccgaaccgggtccccgtaccgttacccggtttaccccccgg

SEQ ID NO: 106246 - DNA, 777 bp, Homo sapiens
  misc_feature: GYAE6OF02H3DJE.36.59.F04.1.454.CMB.1.raw
  modified_base (323)..(323): a, c, t, g, unknown or other
  misc_feature (323)..(323): n is a, c, g, or t
tcagtacgctgtctcacgaccggtgctcgatttagtacacacacttagggatcagggctgaacagagagaactcaccatggagtttgggctgagcgtggctttttcttgtggcttagtttttaaaaggtgttccagtgtgaggtgcaggtgtcggaatcgtgggggaggcttggttcagcgtgggggtcctgagactctctgtgcagtctctaggtacttaattctttagtgatactcgctatcgatcgtggtccgcaggctccggagggaacgggcgtagggaggttcgggtctcgagacgtaaattaaggtgggtagggtnacttccactacgattaccggccgacgtccggggtacggggggtccgttaccgacctacgtaccgaccgtaggaaccaaacgtacccgtacgacggagaccgacggtactaagtactacgtacaactaaacgtcggaacccaacggtacgccgtacggaacgtacggacggaaggtaccggacggtaccgggttatttagtttaggttacggttcgtaacggaacgtaaccgaccgttaacccgtaaaccgggtacgtaacccgtaacgttacggtttcgggttacgttttacgttttttcggttttaacggtttttttccgggaccgggtttaaacggtaccgtttaacggttaccggttaacccgttacggtttccccttacgttaaccggtacccttaccccgtcccgtaaccggaacccggtacccgttcccggtttcccggttacccccg

SEQ ID NO: 106247 - DNA, 626 bp, Homo sapiens
  misc_feature: GYAE6OF02JZJIT.36.59.F04.1.454.CMB.1.raw
  modified_base (190)..(190): a, c, t, g, unknown or other
  misc_feature (190)..(190): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
tcagtacgctgtctcacgaccggtgctcgatttagtacacacacttagggagtcgagggctgaacagagagaactcaccatggagtttgggctgagcgtggcttttctgtggctgtttaaagtgtccagtgtgagtgcagtgtcggatcgtgggagctggtcagccgtggggtccctgagactctcctgngcagtctctggattaatcttagtgactgtgcctatgactccgtagggtcccacacggcttccgagggaaggggtcctgggtagtgggtctacaggtaccaagttaagnggtaaggggtnagttccactacagttacgcggtaactccggngggggtccttnacctatacgaccaganactaacnccaaggngactcggacagtacttcgacgataaacncnctancgtcaggacgtacgagaacgtacgacgttacgttaattgttacgcgtcgaaagacgtagaaggtcggttacggtcggttacgtacgtacggtcgggaccgtaccggtaccgtcgtaccgtaccttcgccgttaccgaccggtccttaaccggacccgtaacggcccctacgttccggttcccgttcccgcggtaacctcccgtacgtcccg

SEQ ID NO: 106248 - DNA, 593 bp, Homo sapiens
  misc_feature: GYAE6OF02GRJFH.36.59.F04.1.454.CMB.1.raw
  modified_base (249)..(249): a, c, t, g, unknown or other
  misc_feature (249)..(249): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtggggggaggcttggttcagcctggggggtccctgagactctcctgtgcagtctctggattaatctttagtgactatgccatgatctgggtccnccaggctccgaggggaagggctggaggtgggtctcagcaattaatgggtagggtgattcaccacattacggcggacgtccggtcggggggccgttcacctatcaccagagaccaactcaggagcacgctatatctgcaaatcgacacagcctgagagtacgacggacgacgggccgtagtattagttgtgcgagacgacgtcccgaacgtcgaccactagttggtcgttcgttttgtttacgttttttcggaccgtaccgggacgtaacgttggtaccgtacccgttcttccttacgtacgtccctccgaacccgaccgggaccctaccgtccggttacccccg

SEQ ID NO: 106249 - DNA, 619 bp, Homo sapiens
  misc_feature: GYAE6OF02JENJN.36.59.F04.1.454.CMB.1.raw
  modified_base (481)..(481): a, c, t, g, unknown or other
  misc_feature (481)..(481): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatctgggggaggcttggttcagcctggggggtccctgagactctcctgtgcagtctctggattaatctttagtgactatgccatgatctgggtccgccaggctccgagggaaggggctggagtgggtctcagcaatttaagtgggtaggggtgacttcaaccacgtattaacgccgggtaacctccgggtacgggggggtcccggtttacaccgataccaccgaggacgaacgaacctcccgaaggagacacggactatatctagcaaaatgacagacgcgtgagagtcgaggacgacggcgtgtattatgtgcgagagactaccgacgngaccacagttggtagtcttttgttacgttttttcggaccgtaccgggtactaagtcggtaccgtaccgttaccgtcgtttacctacgttcccttacccgacccgtaaccgggtaccctaccgtccggtttacccccgg

SEQ ID NO: 106250 - DNA, 899 bp, Homo sapiens
  misc_feature: GYAE6OF02F0J83.36.59.F04.1.454.CMB.1.raw
tcagtacgctgtctcacgaccggtgctcgatttagtacacacacttagggatcagggctgaacagagagaactcaccatggagtttgggctgagctggctttttcttgtggcttgttttaaaaggtgtccagtgtgaggtgcaggtgtcggaatcgtggggggaggtcttggttcagccgtggggggtccctgagactctcctgtgcagtctctggtattaattcgtttagtgtactagtcgcctatgtactcgtcggggtcccgaccgacggtcctaccggaagggggggggaacggtcgtagggtaggttcgggtcctacgaagtactaaaagtttaaggtgggggttaaggggtgtaacttaccgaacctaacgtaacgttaccggaccgggtaaccggttcccgggggtacggggggggtccccggtttaccaacccgtaacgttaccccgaacccgtaaggaaccgaaaccctaaaccgtcccggaaagggacgacccgtaaccgtacctttaagtacgtcgttacgaacctaaacgtccgacccgaaccgtacgccgtaggaacggtaacggtacgggtaacgggaccggtaaccgggtaccggtttaggttaacgtttaggttaggtacggtacggtaaggtaacggtaacccgtaacccggtaaacgggtaccgtaacccgtaccgttagggtttcggtttacggttttacggttttttacggtttaacgggtttttttacgggaacccgggttaacgggtaaccgtaacgggttaccgggttacccgttacccgtttacccgttaccgtttacccgtacccgttaccccgttacccgtaacccgggtaacccgggtaccccgttacccggtttccccggttacccccccg

SEQ ID NO: 106251 - DNA, 828 bp, Homo sapiens
  misc_feature: GYAE6OF02IFA4V.36.59.F04.1.454.CMB.1.raw
  modified_base (130)..(130): a, c, t, g, unknown or other
  misc_feature (130)..(130): n is a, c, g, or t
  modified_base (329)..(329): a, c, t, g, unknown or other
  misc_feature (329)..(329): n is a, c, g, or t
tcagtacgctgtctcacgaccggtgctcgatttagtacacacacttagggatcaggctgaacagagagaactcaccatggagtttgggctgagctggtcttttttcttgtggcttagtttttaaaaggtntccagtgtgaggtgcaggtgtcggaatcgtggggggaggcttggttcagccgtcggggggcccctgagactctcctgtgcagtcctcgtggtattaattcttttagtgtactatgcctatgatcgtgggtcccgcaggtctaccggaggggaaggacgtggaggttcggtctcgagactaatttaagtgggtaggggtntatttacacctactaagttacggcggtacgttccgggtaggggggtccgttcaccgtactcaccgagagactacctaccgaggacacacgtctaattactcgtacgaacaaagttcgaccctaactacgcccgtagggaacggtaaggtaaccggacgggaaaccggtacccggggtaccgggttaacggttttaattttaacgggttttagtcgggtaccgtaaagggtaaccgtaacgtaaacccccgggtaaggggttaaccgtaaacccttacggtaaacggtttttcgggtttccggttttcggttttttttaacggttttaggtttttttttacccggggacccggttaacgggggttaaaccttaaccgggtttacggtttaaccccggttaacccgtttcccggtttcctttaacccgaccggttcccctaacccgttaacccgggtaacccgggttacccctaccgggtttccccggttttaccccccgg

SEQ ID NO: 106252 - DNA, 858 bp, Homo sapiens
  misc_feature: GYAE6OF02G099D.36.59.F04.1.454.CMB.1.raw
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
tcagtacgctgtctcacgaccggtgctcgatttagtacacacacttagggatcagggctgaacagagagaactcaccatggagtttgggctgagcgtgtcgttttctaggtcggctagttttaaaaggtgtccagtgtgaggtgcaggtgtcggaatctggggggaggcttggttcagccgtgggggtccctgagactctcctgtgcagtctntggattatcttagtgactancgcatgtatctcggtccgccaggcctccggaggggacggggtcgtggtagtcgggtcctacgagtactaaagttaagtggggtaaggggtntacgttaccaccgtacgttaacgtaccggtcgggtacgtccccggggtcgggggggtacccggttaccgaacaccgttaccgaacccgtagaaccggtacctaaccctccgaagggacgccacggtacttacttaattcccgagtaacccgtaaagtccaccgaacgacggtaccggttacggaacgggtaacggtaacccggggaacgggacccggtaaacccggggttcccggttaagtttacgtttaagttcggttacggaacgggtaacgtaacgtaacccgttaacccggaacccgggttaccgtaaaccctacgttaaccgtttggttccggttttacgtttttacgttttacggttttttaccgggaacccggttaacgggtaaccgttaacgggttccgggttaacccgttacccgggtttacccttaccgtttaacccgtaccggttacccccttacccgggtaaacccccggtaaaccgggttaccccccggtacccggttttacccccggggttacccccccg

SEQ ID NO: 106253 - DNA, 619 bp, Homo sapiens
  misc_feature: GYAE6OF02GYFUK.36.59.F04.1.454.CMB.1.raw
tcagtacgctgtctcacgaccggtgctcgatttagtacacacacttagggattggggagctctgagagaggagcccagccctgggattttcaggtgttttcatttggtgatcagggctgaacagagagaactcaccatggagtttgggctgagctggctttttcttgtggctgttttaaaaggtgtccagtgtgaggtgcgaggtgtcggaatcgtgggggaggcgttggttcgaggccgtgggggtccctgagactctcctgtcgcagtctctggattaatctttagtgactatgccatgatcgtgggtcccgccgacggcgtccgaggggaaggggctgggaggttgggtctcgagtacaattaagtgggtaggggtgtacttcgaccactacgttacgaccggacgttccgggtggggggtcccgttaccgcctaagtcccgacagaacgaaccaacgtccgaagggacgaccgacgacttaactagtccgtagaactaagtacgcacacgtctaggaagtacggtcgaacggcgaacggtccgtagttattagtgtcggacgtaggagtaaccgtcccgaacgggtcaaccgtactaggttcgttacgtttacgg

SEQ ID NO: 106254 - DNA, 847 bp, Homo sapiens
  misc_feature: GYAE6OF02FVZDR.36.59.F04.1.454.CMB.1.raw
  modified_base (331)..(331): a, c, t, g, unknown or other
  misc_feature (331)..(331): n is a, c, g, or t
tcagtacgctgtctcacgaccggtgctcgatttagtacacacacttagggatcagggctgaacagagagaactcaccatggagtttgggctgagctggctttttcttgtggctgttttaaaaggtgtccagtgtgaggtgcaggtgtcggaatcgtgggggaggtcttggttcagccgtggggggtcctgagactctcctgtgcagtctctaggtattaattcgtttaagtgtactatgccatgatcgtcgggtccgaccgaggtctccgaaggggaacgggtcgtgggtaggtgggtctacgtagactaagttaagtcgggttaggggtntacgttaccaccgtaactagttaccggcggtaccgttccggggtcgggggggtcccgttaccaaccgtacgttacccgaaccgtaaggaacgtaaacctaaaccgttaccggaagggtaaccgccgtaaaccggtacttaaactacgttaccgtacgaacctaaaaggtcggtaaccaacgaaccggtccgtaaggaacggtaacgggtacggtaaccgggtaaccgaccgggttaccgtttaacggttaacgttttaacggttcgggttacggacgggtaacgacgttaacccggtaacccgggtaacggttaccgtaaacccgttacgttaacgggtttcggttacgttttacgttttaacgggtttttacgttttacccgggaacccgggttaacggtaccgttaacggttaccggttaaccttacccggttacccttacgttccgttacccgtacccgtaacccggtaacccggacccggttaccgttacccggtaccccggtttcccccgg

SEQ ID NO: 106255 - DNA, 219 bp, Homo sapiens
  misc_feature: GYAE6OF01A0CMC.30.20.B09.1.454.CMB.1.raw
  modified_base (213)..(219): a, c, t, g, unknown or other
  misc_feature (213)..(219): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnn

SEQ ID NO: 106256 - DNA, 240 bp, Homo sapiens
  misc_feature: GYAE6OF01DVPKU.30.20.B09.1.454.CMB.1.raw
  modified_base (129)..(129): a, c, t, g, unknown or other
  misc_feature (129)..(129): n is a, c, g, or t
  modified_base (214)..(240): a, c, t, g, unknown or other
  misc_feature (214)..(240): n is a, c, g, or t
tcagcacgctacgtcacgaccggtgctcgatttagtgtagtgtgaagggtgccggagggacctggtcaccgtctcctcagcctccaccaagggcccatcggtcttccccctggcaccatcctccgaagngcacctctggggcacagcggccctgggctgcctggtcaaggctacttcacgtagcgtgctgagcgggctggcaaggcgcagtagnnnnnnnnnnnnnnnnnnnnnnnnnnn

SEQ ID NO: 106257 - DNA, 217 bp, Homo sapiens
  misc_feature: GYAE6OF01DOX0N.30.20.B09.1.454.CMB.1.raw
  modified_base (213)..(217): a, c, t, g, unknown or other
  misc_feature (213)..(217): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnn

SEQ ID NO: 106258 - DNA, 214 bp, Homo sapiens
  misc_feature: GYAE6OF01DSUE6.30.20.B09.1.454.CMB.1.raw
  modified_base (213)..(214): a, c, t, g, unknown or other
  misc_feature (213)..(214): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnn

SEQ ID NO: 106259 - DNA, 216 bp, Homo sapiens
  misc_feature: GYAE6OF01CJ8I5.30.20.B09.1.454.CMB.1.raw
  modified_base (213)..(216): a, c, t, g, unknown or other
  misc_feature (213)..(216): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnn

SEQ ID NO: 106260 - DNA, 216 bp, Homo sapiens; identical to SEQ ID NO: 106259
  misc_feature: GYAE6OF01CNS06.30.20.B09.1.454.CMB.1.raw
  modified_base (213)..(216): a, c, t, g, unknown or other
  misc_feature (213)..(216): n is a, c, g, or t

SEQ ID NO: 106261 - DNA, 216 bp, Homo sapiens; identical to SEQ ID NO: 106259
  misc_feature: GYAE6OF01CXISF.30.20.B09.1.454.CMB.1.raw
  modified_base (213)..(216): a, c, t, g, unknown or other
  misc_feature (213)..(216): n is a, c, g, or t

SEQ ID NO: 106262 - DNA, 233 bp, Homo sapiens
  misc_feature: GYAE6OF01AL7KC.30.20.B09.1.454.CMB.1.raw
  modified_base (212)..(233): a, c, t, g, unknown or other
  misc_feature (212)..(233): n is a, c, g, or t
tcagcacgctacgtcacgaccggtgctcgatttagtgtagtgtgaagggtgccgagggaaccctggtcaccgtctcctcagcctccaccaaggcccatcggtcttcccctggcaccatcctccaagagcacctctggggcacagcggccctgggctgcctggtcaaggactacttccacgtagcgtgctgagcggctggcaaggcgcatagnnnnnnnnnnnnnnnnnnnnnn

SEQ ID NO: 106263 - DNA, 222 bp, Homo sapiens
  misc_feature: GYAE6OF01BCFR6.30.20.B09.1.454.CMB.1.raw
  modified_base (214)..(222): a, c, t, g, unknown or other
  misc_feature (214)..(222): n is a, c, g, or t
tcagcacgctacgtcacgaccggtgctcgatttagtgtagtgtgaagggtgccgagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnnnn

SEQ ID NO: 106264 - DNA, 214 bp, Homo sapiens; identical to SEQ ID NO: 106258
  misc_feature: GYAE6OF01EM4KV.30.20.B09.1.454.CMB.1.raw
  modified_base (213)..(214): a, c, t, g, unknown or other
  misc_feature (213)..(214): n is a, c, g, or t

SEQ ID NO: 106265 - DNA, 213 bp, Homo sapiens
  misc_feature: GYAE6OF01EFO1R.30.20.B09.1.454.CMB.1.raw
  modified_base (213)..(213): a, c, t, g, unknown or other
  misc_feature (213)..(213): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagn

SEQ ID NO: 106266 - DNA, 215 bp, Homo sapiens
  misc_feature: GYAE6OF01B53CS.30.20.B09.1.454.CMB.1.raw
  modified_base (213)..(215): a, c, t, g, unknown or other
  misc_feature (213)..(215): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnn

SEQ ID NO: 106267 - DNA, 217 bp, Homo sapiens; identical to SEQ ID NO: 106257
  misc_feature: GYAE6OF01AGJ6D.30.20.B09.1.454.CMB.1.raw
  modified_base (213)..(217): a, c, t, g, unknown or other
  misc_feature (213)..(217): n is a, c, g, or t

SEQ ID NO: 106268 - DNA, 215 bp, Homo sapiens; identical to SEQ ID NO: 106266
  misc_feature: GYAE6OF01CKE0P.30.20.B09.1.454.CMB.1.raw
  modified_base (213)..(215): a, c, t, g, unknown or other
  misc_feature (213)..(215): n is a, c, g, or t

SEQ ID NO: 106269 - DNA, 215 bp, Homo sapiens; identical to SEQ ID NO: 106266
  misc_feature: GYAE6OF01BWDPJ.30.20.B09.1.454.CMB.1.raw
  modified_base (213)..(215): a, c, t, g, unknown or other
  misc_feature (213)..(215): n is a, c, g, or t

SEQ ID NO: 106270 - DNA, 216 bp, Homo sapiens
  misc_feature: GYAE6OF01B7QQ9.30.20.B09.1.454.CMB.1.raw
  modified_base (214)..(216): a, c, t, g, unknown or other
  misc_feature (214)..(216): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnn

SEQ ID NO: 106271 - DNA, 216 bp, Homo sapiens; identical to SEQ ID NO: 106259
  misc_feature: GYAE6OF01EPC98.30.20.B09.1.454.CMB.1.raw
  modified_base (213)..(216): a, c, t, g, unknown or other
  misc_feature (213)..(216): n is a, c, g, or t

SEQ ID NO: 106272 - DNA, 213 bp, Homo sapiens
  misc_feature: GYAE6OF01B7LDA.30.20.B09.1.454.CMB.1.raw
  modified_base (213)..(213): a, c, t, g, unknown or other
  misc_feature (213)..(213): n is a, c, g, or t
tcagcacgctacgtcacgaccggtgctcgatttagtgtagtgtgaagggtgtcagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagn

SEQ ID NO: 106273 - DNA, 215 bp, Homo sapiens; identical to SEQ ID NO: 106266
  misc_feature: GYAE6OF01CM2ND.30.20.B09.1.454.CMB.1.raw
  modified_base (213)..(215): a, c, t, g, unknown or other
  misc_feature (213)..(215): n is a, c, g, or t

SEQ ID NO: 106274 - DNA, 216 bp, Homo sapiens; identical to SEQ ID NO: 106259
  misc_feature: GYAE6OF01CO39C.30.20.B09.1.454.CMB.1.raw
  modified_base (213)..(216): a, c, t, g, unknown or other
  misc_feature (213)..(216): n is a, c, g, or t

SEQ ID NO: 106275 - DNA, 218 bp, Homo sapiens
  misc_feature: GYAE6OF01CWFOW.30.20.B09.1.454.CMB.1.raw
  modified_base (214)..(218): a, c, t, g, unknown or other
  misc_feature (214)..(218): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnn

SEQ ID NO: 106276 - DNA, 214 bp, Homo sapiens; identical to SEQ ID NO: 106258
  misc_feature: GYAE6OF01BWAWR.30.20.B09.1.454.CMB.1.raw
  modified_base (213)..(214): a, c, t, g, unknown or other
  misc_feature (213)..(214): n is a, c, g, or t

SEQ ID NO: 106277 - DNA, 216 bp, Homo sapiens; identical to SEQ ID NO: 106259
  misc_feature: GYAE6OF01DA2XW.30.20.B09.1.454.CMB.1.raw
  modified_base (213)..(216): a, c, t, g, unknown or other
  misc_feature (213)..(216): n is a, c, g, or t

SEQ ID NO: 106278 - DNA, 227 bp, Homo sapiens
  misc_feature: GYAE6OF01BAL6W.30.20.B09.1.454.CMB.1.raw
  modified_base (215)..(227): a, c, t, g, unknown or other
  misc_feature (215)..(227): n is a, c, g, or t
tcagcacgctacgtcacgaccggtgctcgatttagtgtagtgtgaagggtggccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnnnnnnnnn

SEQ ID NO: 106279 - DNA, 228 bp, Homo sapiens
  misc_feature: GYAE6OF01CMDYO.30.20.B09.1.454.CMB.1.raw
  modified_base (215)..(228): a, c, t, g, unknown or other
  misc_feature (215)..(228): n is a, c, g, or t
tcagcacgctacgtcacgaccggtgctcgatttagtgtagtgtgaagggtgccgagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnnnnnnnnnn

SEQ ID NO: 106280 - DNA, 219 bp, Homo sapiens
  misc_feature: GYAE6OF01CMSHY.30.20.B09.1.454.CMB.1.raw
  modified_base (215)..(219): a, c, t, g, unknown or other
  misc_feature (215)..(219): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnn

SEQ ID NO: 106281 - DNA, 227 bp, Homo sapiens
  misc_feature: GYAE6OF01AJEEY.30.20.B09.1.454.CMB.1.raw
  modified_base (215)..(227): a, c, t, g, unknown or other
  misc_feature (215)..(227): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnnnnnnn

SEQ ID NO: 106282 - DNA, 215 bp, Homo sapiens
  misc_feature: GYAE6OF01BX68W.30.20.B09.1.454.CMB.1.raw
  modified_base (214)..(215): a, c, t, g, unknown or other
  misc_feature (214)..(215): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnn

SEQ ID NO: 106283 - DNA, 239 bp, Homo sapiens
  misc_feature: GYAE6OF01BKYVD.30.20.B09.1.454.CMB.1.raw
  modified_base (216)..(239): a, c, t, g, unknown or other
  misc_feature (216)..(239): n is a, c, g, or t
tcagcacgctacgtcacgaccggtgctcgatttagtgtagtgtgaagggtgccgagggaaccctggtcaccgtctcctcagcctccaccaagggcccatcggtcttcccctggcaccatcctccgaagagcacctctgggggcacagcggccctgggctgcctggtcaaggactacttccacgtagcgtgctgagcgggctggcaaggcgcatagnnnnnnnnnnnnnnnnnnnnnnnn

SEQ ID NO: 106284 - DNA, 216 bp, Homo sapiens
  misc_feature: GYAE6OF01BKV5U.30.20.B09.1.454.CMB.1.raw
  modified_base (214)..(216): a, c, t, g, unknown or other
  misc_feature (214)..(216): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnn

SEQ ID NO: 106285 - DNA, 216 bp, Homo sapiens; identical to SEQ ID NO: 106259
  misc_feature: GYAE6OF01AZ8AZ.30.20.B09.1.454.CMB.1.raw
  modified_base (213)..(216): a, c, t, g, unknown or other
  misc_feature (213)..(216): n is a, c, g, or t

SEQ ID NO: 106286 - DNA, 237 bp, Homo sapiens
  misc_feature: GYAE6OF01CG6NS.30.20.B09.1.454.CMB.1.raw
  modified_base (216)..(220): a, c, t, g, unknown or other
  misc_feature (216)..(220): n is a, c, g, or t
  modified_base (222)..(237): a, c, t, g, unknown or other
  misc_feature (222)..(237): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgttagcgtgctgagcgggctggcaaggcgcataggnnnnngnnnnnnnnnnnnnnnn

SEQ ID NO: 106287 - DNA, 217 bp, Homo sapiens
  misc_feature: GYAE6OF01C4X6Y.30.20.B09.1.454.CMB.1.raw
  modified_base (215)..(217): a, c, t, g, unknown or other
  misc_feature (215)..(217): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnn

SEQ ID NO: 106288 - DNA, 215 bp, Homo sapiens
  misc_feature: GYAE6OF01AJ930.30.20.B09.1.454.CMB.1.raw
  modified_base (214)..(215): a, c, t, g, unknown or other
  misc_feature (214)..(215): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnn

SEQ ID NO: 106289 - DNA, 213 bp, Homo sapiens
  misc_feature: GYAE6OF01A5VW3.30.20.B09.1.454.CMB.1.raw
  modified_base (213)..(213): a, c, t, g, unknown or other
  misc_feature (213)..(213): n is a, c, g, or t
tcagcacgctacgtcacgaccggtgctcgatttagtgtagtgtgaagggtgccagggaaccctggtcaccgtctcctcagcctccatcaagggcccatcggtcttcccctggcaccatcctccaagagcacctctggggcacagcggccctgggctgcctggtcaaggactacttccacgtagcgtgctgagcgggctggcaaggcgcatagn

SEQ ID NO: 106290 - DNA, 254 bp, Homo sapiens
  misc_feature: GYAE6OF01AOUP7.30.20.B09.1.454.CMB.1.raw
  modified_base (218)..(254): a, c, t, g, unknown or other
  misc_feature (218)..(254): n is a, c, g, or t
tcagcacgctacgtcacgaccggtgctcgatttagtgtagtgtgaagggtgccgagggaaccctaggtcaccgtctcctcagcctccaccaagggcccatcggtcttccccctggcaccatcctccaagagccacctctgggggcacagcggccctgggctgcctggtcaaggactacttccacgtagcgtgctgagcgggctggcaaggcgcatagnnnnnnnnnnnnnnnnnnnnnnnnnnnnnnnnnnnnn

SEQ ID NO: 106291 - DNA, 215 bp, Homo sapiens; identical to SEQ ID NO: 106266
  misc_feature: GYAE6OF01CFHS6.30.20.B09.1.454.CMB.1.raw
  modified_base (213)..(215): a, c, t, g, unknown or other
  misc_feature (213)..(215): n is a, c, g, or t

SEQ ID NO: 106292 - DNA, 214 bp, Homo sapiens; identical to SEQ ID NO: 106258
  misc_feature: GYAE6OF01BSENF.30.20.B09.1.454.CMB.1.raw
  modified_base (213)..(214): a, c, t, g, unknown or other
  misc_feature (213)..(214): n is a, c, g, or t

SEQ ID NO: 106293 - DNA, 215 bp, Homo sapiens; identical to SEQ ID NO: 106266
  misc_feature: GYAE6OF01BWJ8V.30.20.B09.1.454.CMB.1.raw
  modified_base (213)..(215): a, c, t, g, unknown or other
  misc_feature (213)..(215): n is a, c, g, or t

SEQ ID NO: 106294 - DNA, 218 bp, Homo sapiens
  misc_feature: GYAE6OF01D99PR.30.20.B09.1.454.CMB.1.raw
  modified_base (213)..(218): a, c, t, g, unknown or other
  misc_feature (213)..(218): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnn

SEQ ID NO: 106295 - DNA, 214 bp, Homo sapiens; identical to SEQ ID NO: 106258
  misc_feature: GYAE6OF01CMJUU.30.20.B09.1.454.CMB.1.raw
  modified_base (213)..(214): a, c, t, g, unknown or other
  misc_feature (213)..(214): n is a, c, g, or t

SEQ ID NO: 106296 - DNA, 237 bp, Homo sapiens
  misc_feature: GYAE6OF01CY71Z.30.20.B09.1.454.CMB.1.raw
  modified_base (215)..(237): a, c, t, g, unknown or other
  misc_feature (215)..(237): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnnnnnnnnnnnnnnnnn

SEQ ID NO: 106297 - DNA, 217 bp, Homo sapiens; identical to SEQ ID NO: 106257
  misc_feature: GYAE6OF01E1EG7.30.20.B09.1.454.CMB.1.raw
  modified_base (213)..(217): a, c, t, g, unknown or other
  misc_feature (213)..(217): n is a, c, g, or t

SEQ ID NO: 106298 - DNA, 215 bp, Homo sapiens; identical to SEQ ID NO: 106288
  misc_feature: GYAE6OF01CG53J.30.20.B09.1.454.CMB.1.raw
  modified_base (214)..(215): a, c, t, g, unknown or other
  misc_feature (214)..(215): n is a, c, g, or t

SEQ ID NO: 106299 - DNA, 216 bp, Homo sapiens
  misc_feature: GYAE6OF01C912T.30.20.B09.1.454.CMB.1.raw
  modified_base (214)..(216): a, c, t, g, unknown or other
  misc_feature (214)..(216): n is a, c, g, or t
tcagcacgctacgtcacgaccggtgctcgatttagtgtagtgtgaagggtgccagggaacccaggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnn

SEQ ID NO: 106300 - DNA, 233 bp, Homo sapiens
  misc_feature: GYAE6OF01BQBHS.30.20.B09.1.454.CMB.1.raw
  modified_base (217)..(233): a, c, t, g, unknown or other
  misc_feature (217)..(233): n is a, c, g, or t
tcagcacgctacgtcacgaccggtgctcgatttagtgtagtgtgaagggtggccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcgatagnnnnnnnnnnnnnnnnn

SEQ ID NO: 106301 - DNA, 216 bp, Homo sapiens; identical to SEQ ID NO: 106259
  misc_feature: GYAE6OF01CC40X.30.20.B09.1.454.CMB.1.raw
  modified_base (213)..(216): a, c, t, g, unknown or other
  misc_feature (213)..(216): n is a, c, g, or t

SEQ ID NO: 106302 - DNA, 264 bp, Homo sapiens
  misc_feature: GYAE6OF01E3M4U.30.20.B09.1.454.CMB.1.raw
  modified_base (219)..(264): a, c, t, g, unknown or other
  misc_feature (219)..(264): n is a, c, g, or t
tcagcacgctacgtcacgaccggtgctcgatttagtgtagtgtgaaggggtgccagggaaccctggtcaccgtctcctcagcctccaccaagggcccatcggtcttcccccgtggcaccatcctccaagagcacctctgggggcacagcggccctgggctgcctggtcaaggactacttccacgtagcgtgcctgagcgggctggccaaggcgcatagnnnnnnnnnnnnnnnnnnnnnnnnnnnnnnnnnnnnnnnnnnnnnn

SEQ ID NO: 106303 - DNA, 215 bp, Homo sapiens; identical to SEQ ID NO: 106266
  misc_feature: GYAE6OF01C5BP2.30.20.B09.1.454.CMB.1.raw
  modified_base (213)..(215): a, c, t, g, unknown or other
  misc_feature (213)..(215): n is a, c, g, or t

SEQ ID NO: 106304 - DNA, 217 bp, Homo sapiens; identical to SEQ ID NO: 106287
  misc_feature: GYAE6OF01C0Q77.30.20.B09.1.454.CMB.1.raw
  modified_base (215)..(217): a, c, t, g, unknown or other
  misc_feature (215)..(217): n is a, c, g, or t

SEQ ID NO: 106305 - DNA, 217 bp, Homo sapiens; identical to SEQ ID NO: 106287
  misc_feature: GYAE6OF01EG1EL.30.20.B09.1.454.CMB.1.raw
  modified_base (215)..(217): a, c, t, g, unknown or other
  misc_feature (215)..(217): n is a, c, g, or t

SEQ ID NO: 106306 - DNA, 239 bp, Homo sapiens
  misc_feature: GYAE6OF01CELR2.30.20.B09.1.454.CMB.1.raw
  modified_base (213)..(239): a, c, t, g, unknown or other
  misc_feature (213)..(239): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagctgctgagcgggctggcaaggcgcatagnnnnnnnnnnnnnnnnnnnnnnnnnnn

SEQ ID NO: 106307 - DNA, 215 bp, Homo sapiens
  misc_feature: GYAE6OF01DA4PP.30.20.B09.1.454.CMB.1.raw
  modified_base (212)..(215): a, c, t, g, unknown or other
  misc_feature (212)..(215): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggatacttccacgtagcgtgctgagcgggctggcaaggcgcatagnnnn

SEQ ID NO: 106308 - DNA, 218 bp, Homo sapiens
  misc_feature: GYAE6OF01CXQPI.30.20.B09.1.454.CMB.1.raw
  modified_base (215)..(218): a, c, t, g, unknown or other
  misc_feature (215)..(218): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnn

SEQ ID NO: 106309 - DNA, 216 bp, Homo sapiens
  misc_feature: GYAE6OF01BQKWQ.30.20.B09.1.454.CMB.1.raw
  modified_base (215)..(216): a, c, t, g, unknown or other
  misc_feature (215)..(216): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnn

SEQ ID NO: 106310 - DNA, 241 bp, Homo sapiens
  misc_feature: GYAE6OF01DOX7O.30.20.B09.1.454.CMB.1.raw
  modified_base (215)..(241): a, c, t, g, unknown or other
  misc_feature (215)..(241): n is a, c, g, or t
tcagcacgctacgtcacgaccggtgctcgatttagtgtagtgtgaagggtgaccaggggaaccctggtcaccgtctcctcagcctccaccaagggcccatcggtcttccccctggcaccatcctccaagtgcacctctggggcacagcggccctgggctcgcctggtcaaggactacttcacgtagcgtgctgagcgggctggcaggcgcatagnnnnnnnnnnnnnnnnnnnnnnnnnnn

SEQ ID NO: 106311 - DNA, 215 bp, Homo sapiens
  misc_feature: GYAE6OF01CVQ84.30.20.B09.1.454.CMB.1.raw
  modified_base (215)..(215): a, c, t, g, unknown or other
  misc_feature (215)..(215): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagn

SEQ ID NO: 106312 - DNA, 254 bp, Homo sapiens
  misc_feature: GYAE6OF01CKSHH.30.20.B09.1.454.CMB.1.raw
  modified_base (212)..(254): a, c, t, g, unknown or other
  misc_feature (212)..(254): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggcctgggctgcctggtcaaggactacttccacgtagcgtgctgagcgggctggcaaggcgcatagnnnnnnnnnnnnnnnnnnnnnnnnnnnnnnnnnnnnnnnnnnn

SEQ ID NO: 106313 - DNA, 226 bp, Homo sapiens
  misc_feature: GYAE6OF01EOFUP.30.20.B09.1.454.CMB.1.raw
  modified_base (214)..(226): a, c, t, g, unknown or other
  misc_feature (214)..(226): n is a, c, g, or t
tcagcacgctacgtcacgaccggtgctcgatttagtgtagtgtgaagggtgccagggaaccctggtcaccgtctcctcagcctccaccaaggcccatcggtcttccccctggcaccatcctccaagagcacctctggggcacagcggccctgggctgcctggtcaaggactacttccacgtagcgtgctgagcgggctggcaaggcgcagtagnnnnnnnnnnnnn

SEQ ID NO: 106314 - DNA, 239 bp, Homo sapiens
  misc_feature: GYAE6OF01CE4VS.30.20.B09.1.454.CMB.1.raw
  modified_base (217)..(239): a, c, t, g, unknown or other
  misc_feature (217)..(239): n is a, c, g, or t
tcagcacgctacgtcacgaccggtgctcgatttagtgtagtgtgaagggtgccgagggaaccctggtcaccgtctcctcagcctccaccaagggcccatcggtcttccccctggcaccatcctccaagagcacctcgtgggggcacagcggccctgggctgcctggtcaaggactacttccacgtagcgtgctgagcgggctggcaaggcgcatagnnnnnnnnnnnnnnnnnnnnnnn

SEQ ID NO: 106315 - DNA, 216 bp, Homo sapiens; identical to SEQ ID NO: 106309
  misc_feature: GYAE6OF01BLBKD.30.20.B09.1.454.CMB.1.raw
  modified_base (215)..(216): a, c, t, g, unknown or other
  misc_feature (215)..(216): n is a, c, g, or t

SEQ ID NO: 106316 - DNA, 217 bp, Homo sapiens; identical to SEQ ID NO: 106287
  misc_feature: GYAE6OF01BP09Q.30.20.B09.1.454.CMB.1.raw
  modified_base (215)..(217): a, c, t, g, unknown or other
  misc_feature (215)..(217): n is a, c, g, or t

SEQ ID NO: 106317 - DNA, 214 bp, Homo sapiens
  misc_feature: GYAE6OF01D2M60.30.20.B09.1.454.CMB.1.raw
  modified_base (212)..(214): a, c, t, g, unknown or other
  misc_feature (212)..(214): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggcctgggctgcctggtcaaggactacttccacgtagcgtgctgagcgggctggcaaggcgcatagnnn

SEQ ID NO: 106318 - DNA, 219 bp, Homo sapiens
  misc_feature: GYAE6OF01C8PDI.30.20.B09.1.454.CMB.1.raw
  modified_base (215)..(219): a, c, t, g, unknown or other
  misc_feature (215)..(219): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnn

SEQ ID NO: 106319 - DNA, 216 bp, Homo sapiens; identical to SEQ ID NO: 106284
  misc_feature: GYAE6OF01DLMGC.30.20.B09.1.454.CMB.1.raw
  modified_base (214)..(216): a, c, t, g, unknown or other
  misc_feature (214)..(216): n is a, c, g, or t

SEQ ID NO: 106320 - DNA, 215 bp, Homo sapiens; identical to SEQ ID NO: 106282
  misc_feature: GYAE6OF01BNT6R.30.20.B09.1.454.CMB.1.raw
  modified_base (214)..(215): a, c, t, g, unknown or other
  misc_feature (214)..(215): n is a, c, g, or t

SEQ ID NO: 106321 - DNA, 216 bp, Homo sapiens; identical to SEQ ID NO: 106309
  misc_feature: GYAE6OF01EYP85.30.20.B09.1.454.CMB.1.raw
  modified_base (215)..(216): a, c, t, g, unknown or other
  misc_feature (215)..(216): n is a, c, g, or t

SEQ ID NO: 106322 - DNA, 219 bp, Homo sapiens; identical to SEQ ID NO: 106255
  misc_feature: GYAE6OF01A9G95.30.20.B09.1.454.CMB.1.raw
  modified_base (213)..(219): a, c, t, g, unknown or other
  misc_feature (213)..(219): n is a, c, g, or t

SEQ ID NO: 106323 - DNA, 232 bp, Homo sapiens
  misc_feature: GYAE6OF01AUUYB.30.20.B09.1.454.CMB.1.raw
  modified_base (214)..(232): a, c, t, g, unknown or other
  misc_feature (214)..(232): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnnnnnnnnnnnnnnn

SEQ ID NO: 106324 - DNA, 217 bp, Homo sapiens; identical to SEQ ID NO: 106287
  misc_feature: GYAE6OF01D8YWD.30.20.B09.1.454.CMB.1.raw
  modified_base (215)..(217): a, c, t, g, unknown or other
  misc_feature (215)..(217): n is a, c, g, or t

SEQ ID NO: 106325 - DNA, 218 bp, Homo sapiens; identical to SEQ ID NO: 106308
  misc_feature: GYAE6OF01CBB8W.30.20.B09.1.454.CMB.1.raw
  modified_base (215)..(218): a, c, t, g, unknown or other
  misc_feature (215)..(218): n is a, c, g, or t

SEQ ID NO: 106326 - DNA, 215 bp, Homo sapiens; identical to SEQ ID NO: 106288
  misc_feature: GYAE6OF01EYTE9.30.20.B09.1.454.CMB.1.raw
  modified_base (214)..(215): a, c, t, g, unknown or other
  misc_feature (214)..(215): n is a, c, g, or t

SEQ ID NO: 106327 - DNA, 217 bp, Homo sapiens
  misc_feature: GYAE6OF01BZJED.30.20.B09.1.454.CMB.1.raw
  modified_base (215)..(217): a, c, t, g, unknown or other
  misc_feature (215)..(217): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnn

SEQ ID NO: 106328 - DNA, 223 bp, Homo sapiens
  misc_feature: GYAE6OF01A1V91.30.20.B09.1.454.CMB.1.raw
  modified_base (222)..(223): a, c, t, g, unknown or other
  misc_feature (222)..(223): n is a, c, g, or t
tcagcacgctacgtcacgaccggtgctcgatttagtgtagtgtgaaggtggtccgacgggaaccctcggtcaccgtctcctcagccgtccaccgaagggcccgatcggtcttccccctggcaccatcctccaagagcacctctgggggcacagcggccctgggctgcctggtcaaggactacttccacgtagcgtgctgagcgggctggcaaggcgcatagnn

SEQ ID NO: 106329 - DNA, 216 bp, Homo sapiens; identical to SEQ ID NO: 106309
  misc_feature: GYAE6OF01ADN27.30.20.B09.1.454.CMB.1.raw
  modified_base (215)..(216): a, c, t, g, unknown or other
  misc_feature (215)..(216): n is a, c, g, or t

SEQ ID NO: 106330 - DNA, 216 bp, Homo sapiens; identical to SEQ ID NO: 106309
  misc_feature: GYAE6OF01AD00V.30.20.B09.1.454.CMB.1.raw
  modified_base (215)..(216): a, c, t, g, unknown or other
  misc_feature (215)..(216): n is a, c, g, or t

SEQ ID NO: 106331 - DNA, 219 bp, Homo sapiens; identical to SEQ ID NO: 106318
  misc_feature: GYAE6OF01DADDY.30.20.B09.1.454.CMB.1.raw
  modified_base (215)..(219): a, c, t, g, unknown or other
  misc_feature (215)..(219): n is a, c, g, or t

SEQ ID NO: 106332 - DNA, 219 bp, Homo sapiens; identical to SEQ ID NO: 106318
  misc_feature: GYAE6OF01AJ3XQ.30.20.B09.1.454.CMB.1.raw
  modified_base (215)..(219): a, c, t, g, unknown or other
  misc_feature (215)..(219): n is a, c, g, or t

SEQ ID NO: 106333 - DNA, 214 bp, Homo sapiens; identical to SEQ ID NO: 106258
  misc_feature: GYAE6OF01C16U9.30.20.B09.1.454.CMB.1.raw
  modified_base (213)..(214): a, c, t, g, unknown or other
  misc_feature (213)..(214): n is a, c, g, or t

SEQ ID NO: 106334 - DNA, 214 bp, Homo sapiens; identical to SEQ ID NO: 106258
  misc_feature: GYAE6OF01CJ2KF.30.20.B09.1.454.CMB.1.raw
  modified_base (213)..(214): a, c, t, g, unknown or other
  misc_feature (213)..(214): n is a, c, g, or t

SEQ ID NO: 106335 - DNA, 217 bp, Homo sapiens
  misc_feature: GYAE6OF01EHRA5.30.20.B09.1.454.CMB.1.raw
  modified_base (214)..(217): a, c, t, g, unknown or other
  misc_feature (214)..(217): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnn

SEQ ID NO: 106336 - DNA, 216 bp, Homo sapiens; identical to SEQ ID NO: 106284
  misc_feature: GYAE6OF01EHUPU.30.20.B09.1.454.CMB.1.raw
  modified_base (214)..(216): a, c, t, g, unknown or other
  misc_feature (214)..(216): n is a, c, g, or t

SEQ ID NO: 106337 - DNA, 219 bp, Homo sapiens
  misc_feature: GYAE6OF01CJPW0.30.20.B09.1.454.CMB.1.raw
  modified_base (216)..(219): a, c, t, g, unknown or other
  misc_feature (216)..(219): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatccctccaagagcacctcgtggggcacagcggccctgggctgcctggtcaaggactacttccacgtagcgtgctgagcgggctggcaaggcgcatagnnnn

SEQ ID NO: 106338 - DNA, 217 bp, Homo sapiens; identical to SEQ ID NO: 106287
  misc_feature: GYAE6OF01DQDA0.30.20.B09.1.454.CMB.1.raw
  modified_base (215)..(217): a, c, t, g, unknown or other
  misc_feature (215)..(217): n is a, c, g, or t

SEQ ID NO: 106339 - DNA, 221 bp, Homo sapiens
  misc_feature: GYAE6OF01DVTHK.30.20.B09.1.454.CMB.1.raw
  modified_base (213)..(221): a, c, t, g, unknown or other
  misc_feature (213)..(221): n is a, c, g, or t
tcagcacgctacgtcacgaccggtgctcgatttagtgtagtgtgaagggtgccgagggaaccctggtcaccgtctcctcagcctccaccaagggccatcggtcttcccctggcaccatcctccaagagcacctctgggggcacagcggccctgggctgcctggtcaaggctacttccacgtagcgtgctgagcgggctggcaaggcgcatagnnnnnnnnn

SEQ ID NO: 106340 - DNA, 223 bp, Homo sapiens
  misc_feature: GYAE6OF01ABY05.30.20.B09.1.454.CMB.1.raw
  modified_base (214)..(223): a, c, t, g, unknown or other
  misc_feature (214)..(223): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnnnnnn

SEQ ID NO: 106341 - DNA, 252 bp, Homo sapiens
  misc_feature: GYAE6OF01A9LB3.30.20.B09.1.454.CMB.1.raw
  modified_base (229)..(252): a, c, t, g, unknown or other
  misc_feature (229)..(252): n is a, c, g, or t
tcagcacgctacgtcacgaccggtgctcgatttagtgtagtgtgaagggttggccagggaaccctggtcgtaccgtctcctcagtcctccaccaagggcccatcggtcttccccctggcaccagtcctccaagaggcacctcgtgggggcaccaggcggccctgggctgcctggtcaaggactacttccacggtagccgtgactagagcgggctggcaaggcgcatagnnnnnnnnnnnnnnnnnnnnnnnn

SEQ ID NO: 106342 - DNA, 216 bp, Homo sapiens; identical to SEQ ID NO: 106309
  misc_feature: GYAE6OF01EWHRZ.30.20.B09.1.454.CMB.1.raw
  modified_base (215)..(216): a, c, t, g, unknown or other
  misc_feature (215)..(216): n is a, c, g, or t

SEQ ID NO: 106343 - DNA, 216 bp, Homo sapiens; identical to SEQ ID NO: 106309
  misc_feature: GYAE6OF01D7SL5.30.20.B09.1.454.CMB.1.raw
  modified_base (215)..(216): a, c, t, g, unknown or other
  misc_feature (215)..(216): n is a, c, g, or t

SEQ ID NO: 106344 - DNA, 236 bp, Homo sapiens
  misc_feature: GYAE6OF01C674O.30.20.B09.1.454.CMB.1.raw
  modified_base (216)..(236): a, c, t, g, unknown or other
  misc_feature (216)..(236): n is a, c, g, or t
tcagcacgctacgtcacgaccggtgctcgatttagtgtagtgtgaagggtgccgagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnnnnnnnnnnnnnnn

SEQ ID NO: 106345 - DNA, 216 bp, Homo sapiens; identical to SEQ ID NO: 106309
  misc_feature: GYAE6OF01DJM21.30.20.B09.1.454.CMB.1.raw
  modified_base (215)..(216): a, c, t, g, unknown or other
  misc_feature (215)..(216): n is a, c, g, or t

SEQ ID NO: 106346 - DNA, 214 bp, Homo sapiens
  misc_feature: GYAE6OF01EXRFD.30.20.B09.1.454.CMB.1.raw
  modified_base (213)..(214): a, c, t, g, unknown or other
  misc_feature (213)..(214): n is a, c, g, or t
tcagcacgctacgtcacgaccggtgctcgatttagtgtagtgtgaagggtgccagggaaccctggtcaccgtctcctcagcctccaccaaggcccatcggtcttcccctggcaccatcctccaagagcacctctgggggcacagcggccctgggctgcctggtcaaggactacttccacgtagcgtgctgagcgggctggcaaggcgcatagnn

SEQ ID NO: 106347 - DNA, 220 bp, Homo sapiens
  misc_feature: GYAE6OF01A11M8.30.20.B09.1.454.CMB.1.raw
  modified_base (214)..(220): a, c, t, g, unknown or other
  misc_feature (214)..(220): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnnnn

SEQ ID NO: 106348 - DNA, 219 bp, Homo sapiens; identical to SEQ ID NO: 106318
  misc_feature: GYAE6OF01CRQ2T.30.20.B09.1.454.CMB.1.raw
  modified_base (215)..(219): a, c, t, g, unknown or other
  misc_feature (215)..(219): n is a, c, g, or t

SEQ ID NO: 106349 - DNA, 250 bp, Homo sapiens
  misc_feature: GYAE6OF01EF4IB.30.20.B09.1.454.CMB.1.raw
  modified_base (218)..(250): a, c, t, g, unknown or other
  misc_feature (218)..(250): n is a, c, g, or t
tcagcacgctacgtcacgaccggtgctcgatttagtgtagtgtgaagggtggccaggggaaccctggtcaccgtctcctcacgcctccaccaagggcccatcggtcttccccctggcaccatccctccaagagcacctctgggggcacagcggccctgggctgcctggtcaaggactacttccacgtgcgtgctgagcgggctggcaaggcgcatagnnnnnnnnnnnnnnnnnnnnnnnnnnnnnnnnn

SEQ ID NO: 106350 - DNA, 218 bp, Homo sapiens
  misc_feature: GYAE6OF01EUANN.30.20.B09.1.454.CMB.1.raw
  modified_base (214)..(218): a, c, t, g, unknown or other
  misc_feature (214)..(218): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnn

SEQ ID NO: 106351 - DNA, 218 bp, Homo sapiens; identical to SEQ ID NO: 106308
  misc_feature: GYAE6OF01DQWWC.30.20.B09.1.454.CMB.1.raw
  modified_base (215)..(218): a, c, t, g, unknown or other
  misc_feature (215)..(218): n is a, c, g, or t

SEQ ID NO: 106352 - DNA, 218 bp, Homo sapiens; identical to SEQ ID NO: 106308
  misc_feature: GYAE6OF01DCRXB.30.20.B09.1.454.CMB.1.raw
  modified_base (215)..(218): a, c, t, g, unknown or other
  misc_feature (215)..(218): n is a, c, g, or t

SEQ ID NO: 106353 - DNA, 218 bp, Homo sapiens; identical to SEQ ID NO: 106308
  misc_feature: GYAE6OF01D8432.30.20.B09.1.454.CMB.1.raw
  modified_base (215)..(218): a, c, t, g, unknown or other
  misc_feature (215)..(218): n is a, c, g, or t

SEQ ID NO: 106354 - DNA, 216 bp, Homo sapiens; identical to SEQ ID NO: 106309
  misc_feature: GYAE6OF01EX1K9.30.20.B09.1.454.CMB.1.raw
  modified_base (215)..(216): a, c, t, g, unknown or other
  misc_feature (215)..(216): n is a, c, g, or t

SEQ ID NO: 106355 - DNA, 265 bp, Homo sapiens
  misc_feature: GYAE6OF01DH4TC.30.20.B09.1.454.CMB.1.raw
  modified_base (222)..(265): a, c, t, g, unknown or other
  misc_feature (222)..(265): n is a, c, g, or t
tcagcacgctacgtcacgaccggtgctcgatttagtgtagtgtgaagggtggccagggaaccctggtcaccgtctcctcagcctccaccaagggcccatcggtcttccccctggcaccatcctccaagacgcaccctcgtggggggcacaggcggccctgggcctgcctggtcaaggactacttccacgtagcgtgctgagcgggctggcaaggcgcatagnnnnnnnnnnnnnnnnnnnnnnnnnnnnnnnnnnnnnnnnnnnn

SEQ ID NO: 106356 - DNA, 217 bp, Homo sapiens; identical to SEQ ID NO: 106287
  misc_feature: GYAE6OF01CDOHC.30.20.B09.1.454.CMB.1.raw
  modified_base (215)..(217): a, c, t, g, unknown or other
  misc_feature (215)..(217): n is a, c, g, or t

SEQ ID NO: 106357 - DNA, 255 bp, Homo sapiens
  misc_feature: GYAE6OF01DJNPC.30.20.B09.1.454.CMB.1.raw
  modified_base (203)..(203): a, c, t, g, unknown or other
  misc_feature (203)..(203): n is a, c, g, or t
  modified_base (219)..(255): a, c, t, g, unknown or other
  misc_feature (219)..(255): n is a, c, g, or t
tcagcacgctacgtcacgaccggtgctcgatttagtgtagtgtgaagggtggaccgagggaacctggtcaccgtctcctcagcctccaccaagggcccatcggtcttcccctggcacccatcctccaagagcgacctctgggggcacagcggccctgggctgcctggtcaagggactacttccacgtagcgtgctgagcgggntggcaaggcgcatagnnnnnnnnnnnnnnnnnnnnnnnnnnnnnnnnnnnnn

SEQ ID NO: 106358 - DNA, 218 bp, Homo sapiens; identical to SEQ ID NO: 106308
  misc_feature: GYAE6OF01C7PEW.30.20.B09.1.454.CMB.1.raw
  modified_base (215)..(218): a, c, t, g, unknown or other
  misc_feature (215)..(218): n is a, c, g, or t

SEQ ID NO: 106359 - DNA, 218 bp, Homo sapiens; identical to SEQ ID NO: 106308
  misc_feature: GYAE6OF01A3NYF.30.20.B09.1.454.CMB.1.raw
  modified_base (215)..(218): a, c, t, g, unknown or other
  misc_feature (215)..(218): n is a, c, g, or t

SEQ ID NO: 106360 - DNA, 222 bp, Homo sapiens
  misc_feature: GYAE6OF01CDPWQ.30.20.B09.1.454.CMB.1.raw
  modified_base (216)..(222): a, c, t, g, unknown or other
  misc_feature (216)..(222): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaaagagcacctctgggggcacagcggccctgggctgcctggtcaaggactacttccacgtagcgtgctgagcgggctggcaaggcgcatagnnnnnnn

SEQ ID NO: 106361 - DNA, 218 bp, Homo sapiens; identical to SEQ ID NO: 106308
  misc_feature: GYAE6OF01D45R6.30.20.B09.1.454.CMB.1.raw
  modified_base (215)..(218): a, c, t, g, unknown or other
  misc_feature (215)..(218): n is a, c, g, or t

SEQ ID NO: 106362 - DNA, 217 bp, Homo sapiens; identical to SEQ ID NO: 106287
  misc_feature: GYAE6OF01B7OMI.30.20.B09.1.454.CMB.1.raw
  modified_base (215)..(217): a, c, t, g, unknown or other
  misc_feature (215)..(217): n is a, c, g, or t

SEQ ID NO: 106363 - DNA, 220 bp, Homo sapiens
  misc_feature: GYAE6OF01BW4UL.30.20.B09.1.454.CMB.1.raw
  modified_base (215)..(220): a, c, t, g, unknown or other
  misc_feature (215)..(220): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnn

SEQ ID NO: 106364 - DNA, 219 bp, Homo sapiens; identical to SEQ ID NO: 106318
  misc_feature: GYAE6OF01DVETO.30.20.B09.1.454.CMB.1.raw
  modified_base (215)..(219): a, c, t, g, unknown or other
  misc_feature (215)..(219): n is a, c, g, or t

SEQ ID NO: 106365 - DNA, 221 bp, Homo sapiens
  misc_feature: GYAE6OF01CEG1A.30.20.B09.1.454.CMB.1.raw
  modified_base (215)..(221): a, c, t, g, unknown or other
  misc_feature (215)..(221): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnn

SEQ ID NO: 106366 - DNA, 219 bp, Homo sapiens
  misc_feature: GYAE6OF01BP4YJ.30.20.B09.1.454.CMB.1.raw
  modified_base (214)..(219): a, c, t, g, unknown or other
  misc_feature (214)..(219): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnn

SEQ ID NO: 106367 - DNA, 217 bp, Homo sapiens; identical to SEQ ID NO: 106287
  misc_feature: GYAE6OF01BTH30.30.20.B09.1.454.CMB.1.raw
  modified_base (215)..(217): a, c, t, g, unknown or other
  misc_feature (215)..(217): n is a, c, g, or t

SEQ ID NO: 106368 - DNA, 215 bp, Homo sapiens; identical to SEQ ID NO: 106311
  misc_feature: GYAE6OF01C0AZS.30.20.B09.1.454.CMB.1.raw
  modified_base (215)..(215): a, c, t, g, unknown or other
  misc_feature (215)..(215): n is a, c, g, or t

SEQ ID NO: 106369 - DNA, 219 bp, Homo sapiens; identical to SEQ ID NO: 106366
  misc_feature: GYAE6OF01BARZ6.30.20.B09.1.454.CMB.1.raw
  modified_base (214)..(219): a, c, t, g, unknown or other
  misc_feature (214)..(219): n is a, c, g, or t

SEQ ID NO: 106370 - DNA, 224 bp, Homo sapiens
  misc_feature: GYAE6OF01EZ016.30.20.B09.1.454.CMB.1.raw
  modified_base (215)..(224): a, c, t, g, unknown or other
  misc_feature (215)..(224): n is a, c, g, or t
tcagcacgctacgtcacgaccggtgctcgatttagtgtagtgtgaagggtggccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnnnnnnn

SEQ ID NO: 106371 - DNA, 776 bp, Homo sapiens
  misc_feature: GYAE6OF01AK5YE.30.20.B09.1.454.CMB.1.raw
  modified_base (303)..(303): a, c, t, g, unknown or other
  misc_feature (303)..(303): n is a, c, g, or t
tcagcacgctacgtcacgaccggtgctcgatttagtgtagtgtgaagggtagggccagggaaccctcggtcaccgtctccgtctacgccgtcctaccaaggtcccgatcggtcttccccctggacaccaactcctacgaaaggacgccaccctcggtgggggacttacgacgccggccgtgggtcgtttccgtccgttggtaccgtaaaggttaaacgttaccttcccaagttacgtcgtagtcgtgacggccggtcggtgggacgaacggtcggacgaagtacgtgagcagcgcggggtccngacgtctctcgtgcgcacgcctcgtcggttccgaccgtacgagtacacaactactacgtagacggtcggtcggtcccggaccgacggccgtaccggacggggacggggtcgggtacggtcggtcgtacgttagtttacgtttagttagggtacggtacgtaacgtactacgtaacgtacgacgacgtacgtcggtacggtacggaccgtactacctacctacgtactaccgacgacgacctacgtaacgtaacgaacgtacgtacgttcgttccgttacttaacgtaacgtacgaacgacgtacgtacggacgacggaccggaacggaccggtaccgtaccgttacgttacgttacgtacggtacggacggacggtacggtacgtaacggtaacggttacggttacggttccgttacgttacgttacgttacggtaccggtacgggtaccgggtaccggtaccgggtacccgg

SEQ ID NO: 106372 - DNA, 216 bp, Homo sapiens; identical to SEQ ID NO: 106284
  misc_feature: GYAE6OF01BMKLJ.30.20.B09.1.454.CMB.1.raw
  modified_base (214)..(216): a, c, t, g, unknown or other
  misc_feature (214)..(216): n is a, c, g, or t

SEQ ID NO: 106373 - DNA, 219 bp, Homo sapiens; identical to SEQ ID NO: 106318
  misc_feature: GYAE6OF01DM6JV.30.20.B09.1.454.CMB.1.raw
  modified_base (215)..(219): a, c, t, g, unknown or other
  misc_feature (215)..(219): n is a, c, g, or t

SEQ ID NO: 106374 - DNA, 219 bp, Homo sapiens; identical to SEQ ID NO: 106318
  misc_feature: GYAE6OF01CPZDS.30.20.B09.1.454.CMB.1.raw
  modified_base (215)..(219): a, c, t, g, unknown or other
  misc_feature (215)..(219): n is a, c, g, or t

SEQ ID NO: 106375 - DNA, 220 bp, Homo sapiens; identical to SEQ ID NO: 106363
  misc_feature: GYAE6OF01AHJ0U.30.20.B09.1.454.CMB.1.raw
  modified_base (215)..(220): a, c, t, g, unknown or other
  misc_feature (215)..(220): n is a, c, g, or t

SEQ ID NO: 106376 - DNA, 244 bp, Homo sapiens
  misc_feature: GYAE6OF01DAH96.30.20.B09.1.454.CMB.1.raw
  modified_base (217)..(244): a, c, t, g, unknown or other
  misc_feature (217)..(244): n is a, c, g, or t
tcagcacgctacgtcacgaccggtgctcgatttagtgtagtgtgaagggtggccagggaaccctggtcaccgtctcctcgagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnnnnnnnnnnnnnnnnnnnnnn

SEQ ID NO: 106377 - DNA, 221 bp, Homo sapiens; identical to SEQ ID NO: 106365
  misc_feature: GYAE6OF01B9DQ2.30.20.B09.1.454.CMB.1.raw
  modified_base (215)..(221): a, c, t, g, unknown or other
  misc_feature (215)..(221): n is a, c, g, or t

SEQ ID NO: 106378 - DNA, 219 bp, Homo sapiens; identical to SEQ ID NO: 106255
  misc_feature: GYAE6OF01CLQDY.30.20.B09.1.454.CMB.1.raw
  modified_base (213)..(219): a, c, t, g, unknown or other
  misc_feature (213)..(219): n is a, c, g, or t

SEQ ID NO: 106379 - DNA, 235 bp, Homo sapiens
  misc_feature: GYAE6OF01DBG17.30.20.B09.1.454.CMB.1.raw
  modified_base (214)..(235): a, c, t, g, unknown or other
  misc_feature (214)..(235): n is a, c, g, or t
tcagcacgctacgtcacgaccggtgctcgatttagtgtagtgtgaagggtgccaggggaaccctggtcaccgtctcctcagcctccaccaagggcccatcggtcttcccctggcaccatcctccaagagcacctctggggcacaggcggccctgggctgcctggtcaaggactactccacgtgcgtgctgaggcgggctggcaaggcgcatagnnnnnnnnnnnnnnnnnnnnnn

SEQ ID NO: 106380 - DNA, 245 bp, Homo sapiens
  misc_feature: GYAE6OF01CFI2U.30.20.B09.1.454.CMB.1.raw
  modified_base (218)..(245): a, c, t, g, unknown or other
  misc_feature (218)..(245): n is a, c, g, or t
tcagcacgctacgtcacgaccggtgctcgatttagtgtagtgtgaagggtggccagggaaccctggtcaccgtctcctcagcctccaccaagggcccatcggtcttccccctggcaccatcctccaagacgcacctctgggggcacaggcggccctgggctgcctggtcaaggactacttccacgtagcgtgctgagcgggctggcaaggcgcatagnnnnnnnnnnnnnnnnnnnnnnnnnnnn

SEQ ID NO: 106381 - DNA, 225 bp, Homo sapiens
  misc_feature: GYAE6OF01CDWYG.30.20.B09.1.454.CMB.1.raw
  modified_base (214)..(225): a, c, t, g, unknown or other
  misc_feature (214)..(225): n is a, c, g, or t
tcagcacgctacgtcacgaccggtgctcgatttagtgtagtgtgaagggtgccaggggaaccctggtcaccgtctcctcagcctccaccaaggcccatcggtcttccccctggcaccatcctccaagagcacctctggggcacagcggccctgggctgcctggtcaaggactacttccacgtagcgtgctgagcgggctggcaaggcgcatagnnnnnnnnnnnn

SEQ ID NO: 106382 - DNA, 233 bp, Homo sapiens
  misc_feature: GYAE6OF01BOIB2.30.20.B09.1.454.CMB.1.raw
  modified_base (218)..(233): a, c, t, g, unknown or other
  misc_feature (218)..(233): n is a, c, g, or t
tcagcacgctacgtcacgaccggtgctcgatttagtgtagtgtgaagggtgccgagggaaccctggtcaccgtctcctcagcctccaccaagggcccatcggtcttccccctggcacccatcctccaaagagcacctctgggggcacagcggccctgggctgcctggtcaaggactacttccacgtagcgtgctgagcgggctggcaaggcgcatagnnnnnnnnnnnnnnnn

SEQ ID NO: 106383 - DNA, 217 bp, Homo sapiens; identical to SEQ ID NO: 106287
  misc_feature: GYAE6OF01C6E60.30.20.B09.1.454.CMB.1.raw
  modified_base (215)..(217): a, c, t, g, unknown or other
  misc_feature (215)..(217): n is a, c, g, or t

SEQ ID NO: 106384 - DNA, 219 bp, Homo sapiens; identical to SEQ ID NO: 106318
  misc_feature: GYAE6OF01AW8OL.30.20.B09.1.454.CMB.1.raw
  modified_base (215)..(219): a, c, t, g, unknown or other
  misc_feature (215)..(219): n is a, c, g, or t

SEQ ID NO: 106385 - DNA, 226 bp, Homo sapiens
  misc_feature: GYAE6OF01E1GSD.30.20.B09.1.454.CMB.1.raw
  modified_base (214)..(226): a, c, t, g, unknown or other
  misc_feature (214)..(226): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnnnnnnnnn

SEQ ID NO: 106386 - DNA, 221 bp, Homo sapiens
  misc_feature: GYAE6OF01DOGM7.30.20.B09.1.454.CMB.1.raw
  modified_base (215)..(221): a, c, t, g, unknown or other
  misc_feature (215)..(221): n is a, c, g, or t
tcagcacgctacgtcacgaccggtgctcgatttagtgtagtgtgaagggtgtcagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnn

SEQ ID NO: 106387 - DNA, 217 bp, Homo sapiens
  misc_feature: GYAE6OF01BPX5P.30.20.B09.1.454.CMB.1.raw
  modified_base (213)..(217): a, c, t, g, unknown or other
  misc_feature (213)..(217): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcggctggcaggcgcatagnnnnn

SEQ ID NO: 106388 - DNA, 220 bp, Homo sapiens; identical to SEQ ID NO: 106363
  misc_feature: GYAE6OF01ESZLI.30.20.B09.1.454.CMB.1.raw
  modified_base (215)..(220): a, c, t, g, unknown or other
  misc_feature (215)..(220): n is a, c, g, or t

SEQ ID NO: 106389 - DNA, 217 bp, Homo sapiens
  misc_feature: GYAE6OF01AZ5OV.30.20.B09.1.454.CMB.1.raw
  modified_base (214)..(217): a, c, t, g, unknown or other
  misc_feature (214)..(217): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnn

SEQ ID NO: 106390 - DNA, 231 bp, Homo sapiens
  misc_feature: GYAE6OF01BGXE5.30.20.B09.1.454.CMB.1.raw
  modified_base (214)..(231): a, c, t, g, unknown or other
  misc_feature (214)..(231): n is a, c, g, or t
tcagcacgctacgtcacgaccggtgctcgatttagtgtagtgtgaagggtgccagggaacccgtggtcaccgtctcctcagcctccaccaagggcccatcggtcttccccctggcaccatcctccaagagcacctctggggcacagcggccctgggctgcctggtcaaggactacttccacgtagcgtgctgagcgggctggcaggcgcatagnnnnnnnnnnnnnnnnnn

SEQ ID NO: 106391 - DNA, 223 bp, Homo sapiens
  misc_feature: GYAE6OF01BDVX0.30.20.B09.1.454.CMB.1.raw
  modified_base (215)..(223): a, c, t, g, unknown or other
  misc_feature (215)..(223): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctcgtgggggcacagcgccctgggctgcctggtcaaggactacttccacgtagcgtgctgagcgggctggcaaggcgcatagnnnnnnnnn

SEQ ID NO: 106392 - DNA, 218 bp, Homo sapiens; identical to SEQ ID NO: 106308
  misc_feature: GYAE6OF01AUR6Y.30.20.B09.1.454.CMB.1.raw
  modified_base (215)..(218): a, c, t, g, unknown or other
  misc_feature (215)..(218): n is a, c, g, or t

SEQ ID NO: 106393 - DNA, 220 bp, Homo sapiens
  misc_feature: GYAE6OF01DSK6R.30.20.B09.1.454.CMB.1.raw
  modified_base (213)..(220): a, c, t, g, unknown or other
  misc_feature (213)..(220): n is a, c, g, or t
tcagcacgctacgtcacgaccggtgctcgatttagtgtagtgtgaagggtgccagggaaccctggtcaccgtctcctcagcctccaccaaggcccatcggtcttccccctggcaccatcctccaagagcacctctggggcacagcggccctgggctgcctggtcaaggactacttccacgtagcgtgctgagcgggctggcaaggcgcatagnnnnnnnn

SEQ ID NO: 106394 - DNA, 216 bp, Homo sapiens
  misc_feature: GYAE6OF01EY5UT.30.20.B09.1.454.CMB.1.raw
  modified_base (216)..(216): a, c, t, g, unknown or other
  misc_feature (216)..(216): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctcgtgggggcacagcggccctgggctgcctggtcaaggactacttccacgtagcgtgctgagcgggctggcaaggcgcatagn

SEQ ID NO: 106395 - DNA, 225 bp, Homo sapiens
  misc_feature: GYAE6OF01ECHQ7.30.20.B09.1.454.CMB.1.raw
  modified_base (218)..(225): a, c, t, g, unknown or other
  misc_feature (218)..(225): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctcgtgggggcacgagcggcccgtgggctgcctggtcaaggactacttccacgtagcgtgctgagcgggctggcaaggcgcatagnnnnnnnn

SEQ ID NO: 106396 - DNA, 230 bp, Homo sapiens
  misc_feature: GYAE6OF01C0CMI.30.20.B09.1.454.CMB.1.raw
  modified_base (137)..(137): a, c, t, g, unknown or other
  misc_feature (137)..(137): n is a, c, g, or t
  modified_base (218)..(230): a, c, t, g, unknown or other
  misc_feature (218)..(230): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctcgngggggcacagcggccctgggctgcctggtcaaggactacttccacgtagcgtgctggagcgggctggcaaggcgctatagnnnnnnnnnnnnn

SEQ ID NO: 106397 - DNA, 221 bp, Homo sapiens
  misc_feature: GYAE6OF01BC2SW.30.20.B09.1.454.CMB.1.raw
  modified_base (213)..(221): a, c, t, g, unknown or other
  misc_feature (213)..(221): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggcctgggctgcctggtcaaggactacttccacgtagcgtgctgagcgggctggcaaggcgcatgnnnnnnnnn

SEQ ID NO: 106398 - DNA, 222 bp, Homo sapiens
  misc_feature: GYAE6OF01ASYZR.30.20.B09.1.454.CMB.1.raw
  modified_base (215)..(222): a, c, t, g, unknown or other
  misc_feature (215)..(222): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnn

SEQ ID NO: 106399 - DNA, 249 bp, Homo sapiens
  misc_feature: GYAE6OF01DNYY5.30.20.B09.1.454.CMB.1.raw
  modified_base (222)..(222): a, c, t, g, unknown or other
  misc_feature (222)..(222): n is a, c, g, or t
  modified_base (229)..(249): a, c, t, g, unknown or other
  misc_feature (229)..(249): n is a, c, g, or t
tcagcacgctacgtcacgaccggtgctcgatttagtgtagtgtgaagggtgccagggaaccctggtcaccgtctcctcagcctccaccaagggcccatccggtccttccccctggccaccatcctgcaagacgcacctcgtggggggcacgaggccggcccgtggctcgccgtggtacaaggactactccacgtagcgtgctgaggcgggctggcgaaggcncgatagnnnnnnnnnnnnnnnnnnnnn

SEQ ID NO: 106400 - DNA, 217 bp, Homo sapiens
  misc_feature: GYAE6OF01ARWC3.30.20.B09.1.454.CMB.1.raw
  modified_base (207)..(207): a, c, t, g, unknown or other
  misc_feature (207)..(207): n is a, c, g, or t
  modified_base (212)..(217): a, c, t, g, unknown or other
  misc_feature (212)..(217): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcggctggcaaggcncatgnnnnnn

SEQ ID NO: 106401 - DNA, 282 bp, Homo sapiens
  misc_feature: GYAE6OF01DIFX1.30.20.B09.1.454.CMB.1.raw
  modified_base (263)..(282): a, c, t, g, unknown or other
  misc_feature (263)..(282): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagacgcacctcgtgggggcacgacggccggcccgtggggcctggcccttgggtaccaaacgggaccttaaccttcccgaaacggttacgccggttgccgtgggaaggccggggctgggacgaagggccgacaataggnnnnnnnnnnnnnnnnnnnn

SEQ ID NO: 106402 - DNA, 223 bp, Homo sapiens
  misc_feature: GYAE6OF01AUIVL.30.20.B09.1.454.CMB.1.raw
  modified_base (135)..(135): a, c, t, g, unknown or other
  misc_feature (135)..(135): n is a, c, g, or t
  modified_base (214)..(223): a, c, t, g, unknown or other
  misc_feature (214)..(223): n is a, c, g, or t
tcagcacgctacgtcacgaccggtgctcgatttagtgtagtgtgaagggtgccagggaaccctggtcaccgtctcctcagcctccacaagggcccatcggtcttccccctggcaccatcctccaagagcacctcngggggcacagcggccctgggctgcctggtcaaggactacttccacgtagcgtgctgagcgggctggcaaggcgcatagnnnnnnnnnn

SEQ ID NO: 106403 - DNA, 222 bp, Homo sapiens; identical to SEQ ID NO: 106398
  misc_feature: GYAE6OF01CRJAW.30.20.B09.1.454.CMB.1.raw
  modified_base (215)..(222): a, c, t, g, unknown or other
  misc_feature (215)..(222): n is a, c, g, or t

SEQ ID NO: 106404 - DNA, 212 bp, Homo sapiens
  misc_feature: GYAE6OF02G9PFB.30.20.B09.1.454.CMB.1.raw
  modified_base (210)..(212): a, c, t, g, unknown or other
  misc_feature (210)..(212): n is a, c, g, or t
tcagcacgctacgtcacgaccggtgctcgatttagtgtagtgtgaaggtgccaggaaccctggtcaccgtctcctcagcctccaccaagggcccatcggtcttccctggcaccatcctccaagagcacctctggggcacagcggccctgggctgcctggtcaaggactacttccacgtagcgtgctgagcgggctggcaaggcgcatagnnn

SEQ ID NO: 106405 - DNA, 217 bp, Homo sapiens; identical to SEQ ID NO: 106257
  misc_feature: GYAE6OF02H3S8T.30.20.B09.1.454.CMB.1.raw
  modified_base (213)..(217): a, c, t, g, unknown or other
  misc_feature (213)..(217): n is a, c, g, or t

SEQ ID NO: 106406 - DNA, 214 bp, Homo sapiens
  misc_feature: GYAE6OF02JCM1J.30.20.B09.1.454.CMB.1.raw
  modified_base (212)..(214): a, c, t, g, unknown or other
  misc_feature (212)..(214): n is a, c, g, or t
tcagcacgctacgtcacgaccggtgctcgatttagtgtagtgtgaaggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnn

SEQ ID NO: 106407 - DNA, 220 bp, Homo sapiens
  misc_feature: GYAE6OF02IIT2B.30.20.B09.1.454.CMB.1.raw
  modified_base (215)..(220): a, c, t, g, unknown or other
  misc_feature (215)..(220): n is a, c, g, or t
tcagcacgctacgtcacgaccggtgctcgatttagtgtagtgtgaagggtggccagggaaccctggtcaccgtctcctcagcctccaccaagggcccatcggtcttcccctggcaccatcctccaagacgcacctctggggcacagcggccctgggctgcctggtcaaggactacttccacgtagcgtgctgagcgggctggcaaggcgcatagnnnnnn

SEQ ID NO: 106408 - DNA, 214 bp, Homo sapiens; identical to SEQ ID NO: 106258
  misc_feature: GYAE6OF02JETSZ.30.20.B09.1.454.CMB.1.raw
  modified_base (213)..(214): a, c, t, g, unknown or other
  misc_feature (213)..(214): n is a, c, g, or t

SEQ ID NO: 106409 - DNA, 235 bp, Homo sapiens
  misc_feature: GYAE6OF02I7WYJ.30.20.B09.1.454.CMB.1.raw
  modified_base (226)..(235): a, c, t, g, unknown or other
  misc_feature (226)..(235): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggcctcgccgtggtacgaaggacttacttccacgtagcgtgctgaggcggtcgtggacgaaggcgactagtagnnnnnnnnnn

SEQ ID NO: 106410 - DNA, 215 bp, Homo sapiens; identical to SEQ ID NO: 106266
  misc_feature: GYAE6OF02I2J6Q.30.20.B09.1.454.CMB.1.raw
  modified_base (213)..(215): a, c, t, g, unknown or other
  misc_feature (213)..(215): n is a, c, g, or t

SEQ ID NO: 106411 - DNA, 216 bp, Homo sapiens
  misc_feature: GYAE6OF02I9JC2.30.20.B09.1.454.CMB.1.raw
  modified_base (209)..(216): a, c, t, g, unknown or other
  misc_feature (209)..(216): n is a, c, g, or t
tcagcacgctacgtcacgaccggtgctcgatttagtgtagtgtgaaggtgccagggaacctggtcaccgtctcctcagcctccaccaaggccatcggtcttcccctggccaccatcctccaagagcacctctggggcacagcggcctgggctgcctggtcaaggactacttccacgtagcgtgctgagcgggctggcaaggcgcatagnnnnnnnn

SEQ ID NO: 106412 - DNA, 212 bp, Homo sapiens
  misc_feature: GYAE6OF02HQFDA.30.20.B09.1.454.CMB.1.raw
  modified_base (212)..(212): a, c, t, g, unknown or other
  misc_feature (212)..(212): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtacgtgctgagcgggctggcaaggcgcatagn

SEQ ID NO: 106413 - DNA, 238 bp, Homo sapiens
  misc_feature: GYAE6OF02I7J9H.30.20.B09.1.454.CMB.1.raw
  modified_base (212)..(238): a, c, t, g, unknown or other
  misc_feature (212)..(238): n is a, c, g, or t
tcagcacgctacgtcacgaccggtgctcgatttagtgtagtgtgaaggtgccagggaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnnnnnnnnnnnnnnnnnnnnnnnn

SEQ ID NO: 106414 - DNA, 218 bp, Homo sapiens; identical to SEQ ID NO: 106294
  misc_feature: GYAE6OF02GY07T.30.20.B09.1.454.CMB.1.raw
  modified_base (213)..(218): a, c, t, g, unknown or other
  misc_feature (213)..(218): n is a, c, g, or t

SEQ ID NO: 106415 - DNA, 215 bp, Homo sapiens; identical to SEQ ID NO: 106266
  misc_feature: GYAE6OF02GCNNK.30.20.B09.1.454.CMB.1.raw
  modified_base (213)..(215): a, c, t, g, unknown or other
  misc_feature (213)..(215): n is a, c, g, or t

SEQ ID NO: 106416 - DNA, 225 bp, Homo sapiens
  misc_feature: GYAE6OF02F21F0.30.20.B09.1.454.CMB.1.raw
  modified_base (215)..(225): a, c, t, g, unknown or other
  misc_feature (215)..(225): n is a, c, g, or t
tcagcacgctacgtcacgaccggtgctcgatttagtgtagtgtgaagggtggccagggaaccctggtcaccgtctcctcagcctccaccaagggcccatcggtcttcccctggcaccagtcctccaagagcacctctggggcacagcggccctgggctgcctggtcaaggactacttccacgtagcgtgctgagcgggctggcaaggcgcatagnnnnnnnnnnn

SEQ ID NO: 106417 - DNA, 215 bp, Homo sapiens; identical to SEQ ID NO: 106266
  misc_feature: GYAE6OF02HQ4ON.30.20.B09.1.454.CMB.1.raw
  modified_base (213)..(215): a, c, t, g, unknown or other
  misc_feature (213)..(215): n is a, c, g, or t

SEQ ID NO: 106418 - DNA, 231 bp, Homo sapiens
  misc_feature: GYAE6OF02HI1VQ.30.20.B09.1.454.CMB.1.raw
  modified_base (214)..(231): a, c, t, g, unknown or other
  misc_feature (214)..(231): n is a, c, g, or t
tcagcacgctacgtcacgaccggtgctcgatttagtgtagtgtgaagggtgccgagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnnnnnnnnnnnnn

SEQ ID NO: 106419 - DNA, 214 bp, Homo sapiens; identical to SEQ ID NO: 106258
  misc_feature: GYAE6OF02H3JPX.30.20.B09.1.454.CMB.1.raw
  modified_base (213)..(214): a, c, t, g, unknown or other
  misc_feature (213)..(214): n is a, c, g, or t

SEQ ID NO: 106420 - DNA, 217 bp, Homo sapiens
  misc_feature: GYAE6OF02GL0X9.30.20.B09.1.454.CMB.1.raw
  modified_base (212)..(217): a, c, t, g, unknown or other
  misc_feature (212)..(217): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtctgagcgggctggcaaggcgcatagnnnnnn

SEQ ID NO: 106421 - DNA, 245 bp, Homo sapiens
  misc_feature: GYAE6OF02GRA8E.30.20.B09.1.454.CMB.1.raw
  modified_base (220)..(245): a, c, t, g, unknown or other
  misc_feature (220)..(245): n is a, c, g, or t
tcagcacgctacgtcacgaccggtgctcgatttagtgtagtgtgaagggtgtccgagggaaccctggtcaccgtctcctcagccctccaccaagggccccatccggtcttccccctggcaccatcctccaagagcaccctctggggcacagcggccctgggctgcctggtcaaggactacttccacgtagcgtgctgagcgggctggcaaggcgcatagnnnnnnnnnnnnnnnnnnnnnnnnnn

SEQ ID NO: 106422 - DNA, 214 bp, Homo sapiens; identical to SEQ ID NO: 106258
  misc_feature: GYAE6OF02JASQ9.30.20.B09.1.454.CMB.1.raw
  modified_base (213)..(214): a, c, t, g, unknown or other
  misc_feature (213)..(214): n is a, c, g, or t

SEQ ID NO: 106423 - DNA, 215 bp, Homo sapiens
  misc_feature: GYAE6OF02I3KKM.30.20.B09.1.454.CMB.1.raw
  modified_base (212)..(215): a, c, t, g, unknown or other
  misc_feature (212)..(215): n is a, c, g, or t
tcagcacgctacgtcacgaccggtgctcgatttagtgtagtgtgaagggtgccagggaaccctggtcaccgtctcctcagcctccaccaaggcccatcggtcttcccctggcaccatcctccaagagcacctctggggcacagcggccctgggctgcctggtcaaggactacttccacgtagcgtgctgagcgggctggcaaggcgcatagnnnn

SEQ ID NO: 106424 - DNA, 230 bp, Homo sapiens
  misc_feature: GYAE6OF02HG0W8.30.20.B09.1.454.CMB.1.raw
  modified_base (214)..(230): a, c, t, g, unknown or other
  misc_feature (214)..(230): n is a, c, g, or t
tcagcacgctacgtcacgaccggtgctcgatttagtgtagtgtgaagggtgccgagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnnnnnnnnnnnn

SEQ ID NO: 106425 - DNA, 219 bp, Homo sapiens; identical to SEQ ID NO: 106255
  misc_feature: GYAE6OF02HUKXX.30.20.B09.1.454.CMB.1.raw
  modified_base (213)..(219): a, c, t, g, unknown or other
  misc_feature (213)..(219): n is a, c, g, or t

SEQ ID NO: 106426 - DNA, 264 bp, Homo sapiens
  misc_feature: GYAE6OF02GP0BQ.30.20.B09.1.454.CMB.1.raw
  modified_base (219)..(264): a, c, t, g, unknown or other
  misc_feature (219)..(264): n is a, c, g, or t
tcagcacgctacgtcacgaccggtgctcgatttagtgtagtgtgaagggtggccgagggaaccctggtcaccgtctcctcagcctccaccaagggcccatccggtcttccccctggcaccagtcctccaagagcacctctggggcacagcggccctgggctgcctggtcaaggactacttccacgtagcgtgcctgagcgggctggcaaggcgcatagnnnnnnnnnnnnnnnnnnnnnnnnnnnnnnnnnnnnnnnnnnnnnn

SEQ ID NO: 106427 - DNA, 215 bp, Homo sapiens; identical to SEQ ID NO: 106266
  misc_feature: GYAE6OF02FO30O.30.20.B09.1.454.CMB.1.raw
  modified_base (213)..(215): a, c, t, g, unknown or other
  misc_feature (213)..(215): n is a, c, g, or t

SEQ ID NO: 106428 - DNA, 214 bp, Homo sapiens; identical to SEQ ID NO: 106258
  misc_feature: GYAE6OF02HESLG.30.20.B09.1.454.CMB.1.raw
  modified_base (213)..(214): a, c, t, g, unknown or other
  misc_feature (213)..(214): n is a, c, g, or t

SEQ ID NO: 106429 - DNA, 214 bp, Homo sapiens
  misc_feature: GYAE6OF02IY4IK.30.20.B09.1.454.CMB.1.raw
  modified_base (214)..(214): a, c, t, g, unknown or other
  misc_feature (214)..(214): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagn

SEQ ID NO: 106430 - DNA, 215 bp, Homo sapiens
  misc_feature: GYAE6OF02F0HJ6.30.20.B09.1.454.CMB.1.raw
  modified_base (214)..(215): a, c, t, g, unknown or other
  misc_feature (214)..(215): n is a, c, g, or t
tcagcacgctacgtcacgaccggtgctcgatttagtgtagtgtgaagggtgccagggaacccgtggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnn

SEQ ID NO: 106431 - DNA, 215 bp, Homo sapiens; identical to SEQ ID NO: 106266
  misc_feature: GYAE6OF02IWCJS.30.20.B09.1.454.CMB.1.raw
  modified_base (213)..(215): a, c, t, g, unknown or other
  misc_feature (213)..(215): n is a, c, g, or t

SEQ ID NO: 106432 - DNA, 215 bp, Homo sapiens; identical to SEQ ID NO: 106266
  misc_feature: GYAE6OF02FWRYY.30.20.B09.1.454.CMB.1.raw
  modified_base (213)..(215): a, c, t, g, unknown or other
  misc_feature (213)..(215): n is a, c, g, or t

SEQ ID NO: 106433 - DNA, 215 bp, Homo sapiens; identical to SEQ ID NO: 106266
  misc_feature: GYAE6OF02IP7EF.30.20.B09.1.454.CMB.1.raw
  modified_base (213)..(215): a, c, t, g, unknown or other
  misc_feature (213)..(215): n is a, c, g, or t

SEQ ID NO: 106434 - DNA, 213 bp, Homo sapiens; identical to SEQ ID NO: 106265
  misc_feature: GYAE6OF02IN3PG.30.20.B09.1.454.CMB.1.raw
  modified_base (213)..(213): a, c, t, g, unknown or other
  misc_feature (213)..(213): n is a, c, g, or t

SEQ ID NO: 106435 - DNA, 216 bp, Homo sapiens; identical to SEQ ID NO: 106259
  misc_feature: GYAE6OF02F11U6.30.20.B09.1.454.CMB.1.raw
  modified_base (213)..(216): a, c, t, g, unknown or other
  misc_feature (213)..(216): n is a, c, g, or t

SEQ ID NO: 106436 - DNA, 227 bp, Homo sapiens
  misc_feature: GYAE6OF02GCD36.30.20.B09.1.454.CMB.1.raw
  modified_base (214)..(227): a, c, t, g, unknown or other
  misc_feature (214)..(227): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnnnnnnnnnnn

SEQ ID NO: 106437 - DNA, 215 bp, Homo sapiens; identical to SEQ ID NO: 106266
  misc_feature: GYAE6OF02F5C53.30.20.B09.1.454.CMB.1.raw
  modified_base (213)..(215): a, c, t, g, unknown or other
  misc_feature (213)..(215): n is a, c, g, or t

SEQ ID NO: 106438 - DNA, 214 bp, Homo sapiens; identical to SEQ ID NO: 106258
  misc_feature: GYAE6OF02F666F.30.20.B09.1.454.CMB.1.raw
  modified_base (213)..(214): a, c, t, g, unknown or other
  misc_feature (213)..(214): n is a, c, g, or t

SEQ ID NO: 106439 - DNA, 215 bp, Homo sapiens; identical to SEQ ID NO: 106266
  misc_feature: GYAE6OF02F0AQT.30.20.B09.1.454.CMB.1.raw
  modified_base (213)..(215): a, c, t, g, unknown or other
  misc_feature (213)..(215): n is a, c, g, or t

SEQ ID NO: 106440 - DNA, 272 bp, Homo sapiens
  misc_feature: GYAE6OF02GKXGN.30.20.B09.1.454.CMB.1.raw
  modified_base (227)..(272): a, c, t, g, unknown or other
  misc_feature (227)..(272): n is a, c, g, or t
tcagcacgctacgtcacgaccggtgctcgatttagtgtagtgtgaagggtggtccgagggaaccctggtcaccgtctcctcagcctccaccaagggcccagtccggtcttcccctggcacccagtcctccaagagcacctcgtggggcacgagccggccctgggctgcctggtcaaggactacttccacgtagcgtgcctgagcgggctggaccaagggcgcatagnnnnnnnnnnnnnnnnnnnnnnnnnnnnnnnnnnnnnnnnnnnnnn

SEQ ID NO: 106441 - DNA, 251 bp, Homo sapiens
  misc_feature: GYAE6OF02IJJE1.30.20.B09.1.454.CMB.1.raw
  modified_base (221)..(251): a, c, t, g, unknown or other
  misc_feature (221)..(251): n is a, c, g, or t
tcagcacgctacgtcacgaccggtgctcgatttagtgtagtgtgaaggtgccgagggaacccgtggtcaccgtctcctcagcctccaccaagggcccatcggtcttcccctggcaccgatcctccaagagcacctctggggcacagcggcccgtgggctggcctgggtccaaggactacttcccacgtagcgtgcctgagcgggctggcaaggcgcatagnnnnnnnnnnnnnnnnnnnnnnnnnnnnnnn

SEQ ID NO: 106442 - DNA, 214 bp, Homo sapiens; identical to SEQ ID NO: 106258
  misc_feature: GYAE6OF02IZFJD.30.20.B09.1.454.CMB.1.raw
  modified_base (213)..(214): a, c, t, g, unknown or other
  misc_feature (213)..(214): n is a, c, g, or t

SEQ ID NO: 106443 - DNA, 215 bp, Homo sapiens; identical to SEQ ID NO: 106266
  misc_feature: GYAE6OF02F5TKJ.30.20.B09.1.454.CMB.1.raw
  modified_base (213)..(215): a, c, t, g, unknown or other
  misc_feature (213)..(215): n is a, c, g, or t

SEQ ID NO: 106444 - DNA, 217 bp, Homo sapiens; identical to SEQ ID NO: 106257
  misc_feature: GYAE6OF02GW9GF.30.20.B09.1.454.CMB.1.raw
  modified_base (213)..(217): a, c, t, g, unknown or other
  misc_feature (213)..(217): n is a, c, g, or t

SEQ ID NO: 106445 - DNA, 215 bp, Homo sapiens; identical to SEQ ID NO: 106266
  misc_feature: GYAE6OF02GTFLP.30.20.B09.1.454.CMB.1.raw
  modified_base (213)..(215): a, c, t, g, unknown or other
  misc_feature (213)..(215): n is a, c, g, or t

SEQ ID NO: 106446 - DNA, 218 bp, Homo sapiens; identical to SEQ ID NO: 106294
  misc_feature: GYAE6OF02HPMM8.30.20.B09.1.454.CMB.1.raw
  modified_base (213)..(218): a, c, t, g, unknown or other
  misc_feature (213)..(218): n is a, c, g, or t

SEQ ID NO: 106447 - DNA, 284 bp, Homo sapiens
  misc_feature: GYAE6OF02IEVJT.30.20.B09.1.454.CMB.1.raw
  modified_base (217)..(219): a, c, t, g, unknown or other
  misc_feature (217)..(219): n is a, c, g, or t
  modified_base (221)..(221): a, c, t, g, unknown or other
  misc_feature (221)..(221): n is a, c, g, or t
  modified_base (223)..(227): a, c, t, g, unknown or other
  misc_feature (223)..(227): n is a, c, g, or t
  modified_base (229)..(229): a, c, t, g, unknown or other
  misc_feature (229)..(229): n is a, c, g, or t
  modified_base (232)..(284): a, c, t, g, unknown or other
  misc_feature (232)..(284): n is a, c, g, or t
tcagcacgctacgtcacgaccggtgctcgatttagtgtagtgtgaagggtggccagggaaccctggtcaccgtctcctcagccctccaccaagggccctatcggtcttcccctggcaccatcctccaagagcaccgtctggggcacagccggccctgggctgcctggtcaaggctacttccacgtagcgtctggagcgggctggcaaggcgcatagnnntntnnnnnanaannnnnnnnnnnnnnnnnnnnnnnnnnnnnnnnnnnnnnnnnnnnnnnnnnnnn

SEQ ID NO: 106448 - DNA, 212 bp, Homo sapiens
  misc_feature: GYAE6OF02H7S1A.30.20.B09.1.454.CMB.1.raw
  modified_base (211)..(212): a, c, t, g, unknown or other
  misc_feature (211)..(212): n is a, c, g, or t
tcagcacgctacgtcacgaccggtgctcgatttagtgtagtgtgaagggtgccaggaaccctggtcaccgtctcctcagcctccaccaagggccatcggtcttcccctggcaccatcctccaagagcacctctggggcacagcggccctgggctgcctggtcaaggactacttccacgtagcgtgctgagcgggctggcaaggcgcatagnn

SEQ ID NO: 106449 - DNA, 215 bp, Homo sapiens; identical to SEQ ID NO: 106282
  misc_feature: GYAE6OF02FOM7R.30.20.B09.1.454.CMB.1.raw
  modified_base (214)..(215): a, c, t, g, unknown or other
  misc_feature (214)..(215): n is a, c, g, or t

SEQ ID NO: 106450 - DNA, 213 bp, Homo sapiens; identical to SEQ ID NO: 106265
  misc_feature: GYAE6OF02HGYMZ.30.20.B09.1.454.CMB.1.raw
  modified_base (213)..(213): a, c, t, g, unknown or other
  misc_feature (213)..(213): n is a, c, g, or t

SEQ ID NO: 106451 - DNA, 216 bp, Homo sapiens; identical to SEQ ID NO: 106259
  misc_feature: GYAE6OF02IJBAR.30.20.B09.1.454.CMB.1.raw
  modified_base (213)..(216): a, c, t, g, unknown or other
  misc_feature (213)..(216): n is a, c, g, or t

SEQ ID NO: 106452 - DNA, 252 bp, Homo sapiens
  misc_feature: GYAE6OF02FKG3F.30.20.B09.1.454.CMB.1.raw
  modified_base (217)..(220): a, c, t, g, unknown or other
  misc_feature (217)..(220): n is a, c, g, or t
  modified_base (222)..(252): a, c, t, g, unknown or other
  misc_feature (222)..(252): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacgagcggccctgggctgcctggtcaaggactacttccacgtagcgtgctgagcgggctggcaaggcgcgatagnnnngnnnnnnnnnnnnnnnnnnnnnnnnnnnnnnn

SEQ ID NO: 106453 - DNA, 214 bp, Homo sapiens; identical to SEQ ID NO: 106258
  misc_feature: GYAE6OF02GL5XM.30.20.B09.1.454.CMB.1.raw
  modified_base (213)..(214): a, c, t, g, unknown or other
  misc_feature (213)..(214): n is a, c, g, or t

SEQ ID NO: 106454 - DNA, 224 bp, Homo sapiens
  misc_feature: GYAE6OF02FZ03L.30.20.B09.1.454.CMB.1.raw
  modified_base (218)..(224): a, c, t, g, unknown or other
  misc_feature (218)..(224): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctcgtgggggcacaggccggccctgggctgcctggtcaaggactacttccacgtagcgtgctgagcgggctggcaaggcgcatagnnnnnnn

SEQ ID NO: 106455 - DNA, 217 bp, Homo sapiens; identical to SEQ ID NO: 106257
  misc_feature: GYAE6OF02IK8EP.30.20.B09.1.454.CMB.1.raw
  modified_base (213)..(217): a, c, t, g, unknown or other
  misc_feature (213)..(217): n is a, c, g, or t

SEQ ID NO: 106456 - DNA, 214 bp, Homo sapiens; identical to SEQ ID NO: 106429
  misc_feature: GYAE6OF02GDISU.30.20.B09.1.454.CMB.1.raw
  modified_base (214)..(214): a, c, t, g, unknown or other
  misc_feature (214)..(214): n is a, c, g, or t

SEQ ID NO: 106457 - DNA, 217 bp, Homo sapiens; identical to SEQ ID NO: 106389
  misc_feature: GYAE6OF02H8H7R.30.20.B09.1.454.CMB.1.raw
  modified_base (214)..(217): a, c, t, g, unknown or other
  misc_feature (214)..(217): n is a, c, g, or t

SEQ ID NO: 106458 - DNA, 219 bp, Homo sapiens
  misc_feature: GYAE6OF02FXN3G.30.20.B09.1.454.CMB.1.raw
  modified_base (214)..(219): a, c, t, g, unknown or other
  misc_feature (214)..(219): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnnn

SEQ ID NO: 106459 - DNA, 217 bp, Homo sapiens; identical to SEQ ID NO: 106257
  misc_feature: GYAE6OF02H8TGI.30.20.B09.1.454.CMB.1.raw
  modified_base (213)..(217): a, c, t, g, unknown or other
  misc_feature (213)..(217): n is a, c, g, or t

SEQ ID NO: 106460 - DNA, 216 bp, Homo sapiens
  misc_feature: GYAE6OF02H8FBD.30.20.B09.1.454.CMB.1.raw
  modified_base (213)..(216): a, c, t, g, unknown or other
  misc_feature (213)..(216): n is a, c, g, or t
tcagcacgctacgtcacgaccggtgctcgatttagtgtagtgtgaagggtgccaggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnn

SEQ ID NO: 106461 - DNA, 216 bp, Homo sapiens; identical to SEQ ID NO: 106284
  misc_feature: GYAE6OF02JHTJ1.30.20.B09.1.454.CMB.1.raw
  modified_base (214)..(216): a, c, t, g, unknown or other
  misc_feature (214)..(216): n is a, c, g, or t

SEQ ID NO: 106462 - DNA, 243 bp, Homo sapiens
  misc_feature: GYAE6OF02HZ29D.30.20.B09.1.454.CMB.1.raw
  modified_base (220)..(243): a, c, t, g, unknown or other
  misc_feature (220)..(243): n is a, c, g, or t
tcagcacgctacgtcacgaccggtgctcgatttagtgtagtgtgaagggtggccagggaaccctggtcaccgtctcctcagcctccaccaagggcccatcggtcttccccctggcaccatccctccaagagcacctcgtggggcacaggcggccctgggctgcctggtcaaggacctacttccacgtagcgtgctgacgcgggctggcaaggcgcatagnnnnnnnnnnnnnnnnnnnnnnnn

SEQ ID NO: 106463 - DNA, 215 bp, Homo sapiens; identical to SEQ ID NO: 106288
  misc_feature: GYAE6OF02GSSC8.30.20.B09.1.454.CMB.1.raw
  modified_base (214)..(215): a, c, t, g, unknown or other
  misc_feature (214)..(215): n is a, c, g, or t

SEQ ID NO: 106464 - DNA, 231 bp, Homo sapiens
  misc_feature: GYAE6OF02JJP23.30.20.B09.1.454.CMB.1.raw
  modified_base (214)..(231): a, c, t, g, unknown or other
  misc_feature (214)..(231): n is a, c, g, or t
tcagcacgctacgtcacgaccggtgctcgatttagtgtagtgtgaagggtgccagggaaccctggtcaccgtctcctcagcctccaccaacgggcccatcggtcttcccctggcaccatcctccaagagcacctctggggcacagcggccctgggctgcctggtcaaggactacttccacgtagcgtgctgagcgggctggcaaggcgcatagnnnnnnnnnnnnnnnnnn

SEQ ID NO: 106465 - DNA, 215 bp, Homo sapiens; identical to SEQ ID NO: 106282
  misc_feature: GYAE6OF02GRH3S.30.20.B09.1.454.CMB.1.raw
  modified_base (214)..(215): a, c, t, g, unknown or other
  misc_feature (214)..(215): n is a, c, g, or t

SEQ ID NO: 106466 - DNA, 214 bp, Homo sapiens
  misc_feature: GYAE6OF02G1B1Y.30.20.B09.1.454.CMB.1.raw
  modified_base (212)..(214): a, c, t, g, unknown or other
  misc_feature (212)..(214): n is a, c, g, or t
tcagcacgctacgtcacgaccggtgctcgatttagtgtagtgtgaagggtgccaggaaccctggtcaccgtctcctcagcctccaccaaggcccatcggtcttcccctggcaccatcctccaagagcaccgtctggggcacagcggccctgggctgcctggtcaaggactacttccacgtagcgtgctgagcgggctggcaaggcgcatagnnn

SEQ ID NO: 106467 - DNA, 225 bp, Homo sapiens
  misc_feature: GYAE6OF02F8N4Q.30.20.B09.1.454.CMB.1.raw
  modified_base (214)..(225): a, c, t, g, unknown or other
  misc_feature (214)..(225): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcgatagnnnnnnnnnnnn

SEQ ID NO: 106468 - DNA, 226 bp, Homo sapiens
  misc_feature: GYAE6OF02G12X7.30.20.B09.1.454.CMB.1.raw
  modified_base (214)..(226): a, c, t, g, unknown or other
  misc_feature (214)..(226): n is a, c, g, or t
tcagcacgctacgtcacgaccggtgctcgatttagtgtagtgtgaagggtggccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnnnnnnnn

SEQ ID NO: 106469 - DNA, 219 bp, Homo sapiens; identical to SEQ ID NO: 106255
  misc_feature: GYAE6OF02HR0NM.30.20.B09.1.454.CMB.1.raw
  modified_base (213)..(219): a, c, t, g, unknown or other
  misc_feature (213)..(219): n is a, c, g, or t

SEQ ID NO: 106470 - DNA, 217 bp, Homo sapiens; identical to SEQ ID NO: 106287
  misc_feature: GYAE6OF02FR3WS.30.20.B09.1.454.CMB.1.raw
  modified_base (215)..(217): a, c, t, g, unknown or other
  misc_feature (215)..(217): n is a, c, g, or t

SEQ ID NO: 106471 - DNA, 214 bp, Homo sapiens; identical to SEQ ID NO: 106258
  misc_feature: GYAE6OF02IKQ22.30.20.B09.1.454.CMB.1.raw
  modified_base (213)..(214): a, c, t, g, unknown or other
  misc_feature (213)..(214): n is a, c, g, or t

SEQ ID NO: 106472 - DNA, 215 bp, Homo sapiens; identical to SEQ ID NO: 106266
  misc_feature: GYAE6OF02G944W.30.20.B09.1.454.CMB.1.raw
  modified_base (213)..(215): a, c, t, g, unknown or other
  misc_feature (213)..(215): n is a, c, g, or t

SEQ ID NO: 106473 - DNA, 218 bp, Homo sapiens; identical to SEQ ID NO: 106350
  misc_feature: GYAE6OF02IM7ZK.30.20.B09.1.454.CMB.1.raw
  modified_base (214)..(218): a, c, t, g, unknown or other
  misc_feature (214)..(218): n is a, c, g, or t

SEQ ID NO: 106474 - DNA, 216 bp, Homo sapiens; identical to SEQ ID NO: 106259
  misc_feature: GYAE6OF02IE6XD.30.20.B09.1.454.CMB.1.raw
  modified_base (213)..(216): a, c, t, g, unknown or other
  misc_feature (213)..(216): n is a, c, g, or t

SEQ ID NO: 106475 - DNA, 215 bp, Homo sapiens; identical to SEQ ID NO: 106266
  misc_feature: GYAE6OF02I4HUW.30.20.B09.1.454.CMB.1.raw
  modified_base (213)..(215): a, c, t, g, unknown or other
  misc_feature (213)..(215): n is a, c, g, or t

SEQ ID NO: 106476 - DNA, 214 bp, Homo sapiens; identical to SEQ ID NO: 106258
  misc_feature: GYAE6OF02HJY6E.30.20.B09.1.454.CMB.1.raw
  modified_base (213)..(214): a, c, t, g, unknown or other
  misc_feature (213)..(214): n is a, c, g, or t

SEQ ID NO: 106477 - DNA, 217 bp, Homo sapiens
  misc_feature: GYAE6OF02IPMEV.30.20.B09.1.454.CMB.1.raw
  modified_base (212)..(217): a, c, t, g, unknown or other
  misc_feature (212)..(217): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactactccacgtagcgtgctgagcgggctggcaaggcgcatagnnnnnn

SEQ ID NO: 106478 - DNA, 222 bp, Homo sapiens
  misc_feature: GYAE6OF02GCP7Z.30.20.B09.1.454.CMB.1.raw
  modified_base (214)..(222): a, c, t, g, unknown or other
  misc_feature (214)..(222): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnnnnnn

SEQ ID NO: 106479 - DNA, 217 bp, Homo sapiens; identical to SEQ ID NO: 106335
  misc_feature: GYAE6OF02GMSNW.30.20.B09.1.454.CMB.1.raw
  modified_base (214)..(217): a, c, t, g, unknown or other
  misc_feature (214)..(217): n is a, c, g, or t

SEQ ID NO: 106480 - DNA, 215 bp, Homo sapiens; identical to SEQ ID NO: 106266
  misc_feature: GYAE6OF02II8GN.30.20.B09.1.454.CMB.1.raw
  modified_base (213)..(215): a, c, t, g, unknown or other
  misc_feature (213)..(215): n is a, c, g, or t

SEQ ID NO: 106481 - DNA, 214 bp, Homo sapiens
  misc_feature: GYAE6OF02IJ0X4.30.20.B09.1.454.CMB.1.raw
  modified_base (212)..(214): a, c, t, g, unknown or other
  misc_feature (212)..(214): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactcttccacgtagcgtgctgagcgggctggcaaggcgcatagnnn

SEQ ID NO: 106482 - DNA, 218 bp, Homo sapiens; identical to SEQ ID NO: 106294
  misc_feature: GYAE6OF02I6WN4.30.20.B09.1.454.CMB.1.raw
  modified_base (213)..(218): a, c, t, g, unknown or other
  misc_feature (213)..(218): n is a, c, g, or t

SEQ ID NO: 106483 - DNA, 229 bp, Homo sapiens
  misc_feature: GYAE6OF02HEX9R.30.20.B09.1.454.CMB.1.raw
  modified_base (214)..(229): a, c, t, g, unknown or other
  misc_feature (214)..(229): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcataggnnnnnnnnnnnnnnnn

SEQ ID NO: 106484 - DNA, 248 bp, Homo sapiens
  misc_feature: GYAE6OF02IZWXG.30.20.B09.1.454.CMB.1.raw
  modified_base (217)..(248): a, c, t, g, unknown or other
  misc_feature (217)..(248): n is a, c, g, or t
tcagcacgctacgtcacgaccggtgctcgatttagtgtagtgtgaagggtgccgagggaaccctggtcaccgtctcctcagcctccaccaagggcccatcggtcttccccctggcaccactcctccaagagcaccgtctggggcacagcggccctgggctgcctggtcaaggactacttccacgtagcgtgctgagcgggctggcaaggcgcatagnnnnnnnnnnnnnnnnnnnnnnnnnnnnnnnn

SEQ ID NO: 106485 - DNA, 230 bp, Homo sapiens
  misc_feature: GYAE6OF02GC54K.30.20.B09.1.454.CMB.1.raw
  modified_base (216)..(230): a, c, t, g, unknown or other
  misc_feature (216)..(230): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatccctccaagagcacctcgtcggggcacagcggccctgggctgcctggtcaaggactacttccacgtagcgtgctgagcgggctggcaggcgcatagnnnnnnnnnnnnnnn

SEQ ID NO: 106486 - DNA, 219 bp, Homo sapiens; identical to SEQ ID NO: 106366
  misc_feature: GYAE6OF02FHKEX.30.20.B09.1.454.CMB.1.raw
  modified_base (214)..(219): a, c, t, g, unknown or other
  misc_feature (214)..(219): n is a, c, g, or t

SEQ ID NO: 106487 - DNA, 216 bp, Homo sapiens; identical to SEQ ID NO: 106259
  misc_feature: GYAE6OF02HISIA.30.20.B09.1.454.CMB.1.raw
  modified_base (213)..(216): a, c, t, g, unknown or other
  misc_feature (213)..(216): n is a, c, g, or t

SEQ ID NO: 106488 - DNA, 236 bp, Homo sapiens
  misc_feature: GYAE6OF02GMA2I.30.20.B09.1.454.CMB.1.raw
  modified_base (215)..(236): a, c, t, g, unknown or other
  misc_feature (215)..(236): n is a, c, g, or t
tcagcacgctacgtcacgaccggtgctcgatttagtgtagtgtgaagggtgccgagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaagggcgcatagnnnnnnnnnnnnnnnnnnnnnn

SEQ ID NO: 106489 - DNA, 217 bp, Homo sapiens; identical to SEQ ID NO: 106287
  misc_feature: GYAE6OF02F66DS.30.20.B09.1.454.CMB.1.raw
  modified_base (215)..(217): a, c, t, g, unknown or other
  misc_feature (215)..(217): n is a, c, g, or t

SEQ ID NO: 106490 - DNA, 238 bp, Homo sapiens
  misc_feature: GYAE6OF02F4B3T.30.20.B09.1.454.CMB.1.raw
  modified_base (217)..(238): a, c, t, g, unknown or other
  misc_feature (217)..(238): n is a, c, g, or t
tcagcacgctacgtcacgaccggtgctcgatttagtgtagtgtgaagggtggccagggaaccctggtcaccgtctcctcagcctccaccaagggcccatcggtccttcccctggcaccatcctccaagagcacctctgggggcacagcggccctgggcgtgcctggtcaaggactacttccacgtagcgtgctgagcgggctggcaaggcgcatagnnnnnnnnnnnnnnnnnnnnnn

SEQ ID NO: 106491 - DNA, 215 bp, Homo sapiens; identical to SEQ ID NO: 106266
  misc_feature: GYAE6OF02IE97A.30.20.B09.1.454.CMB.1.raw
  modified_base (213)..(215): a, c, t, g, unknown or other
  misc_feature (213)..(215): n is a, c, g, or t

SEQ ID NO: 106492 - DNA, 216 bp, Homo sapiens; identical to SEQ ID NO: 106284
  misc_feature: GYAE6OF02II7OQ.30.20.B09.1.454.CMB.1.raw
  modified_base (214)..(216): a, c, t, g, unknown or other
  misc_feature (214)..(216): n is a, c, g, or t

SEQ ID NO: 106493 - DNA, 221 bp, Homo sapiens; identical to SEQ ID NO: 106365
  misc_feature: GYAE6OF02JWS03.30.20.B09.1.454.CMB.1.raw
  modified_base (215)..(221): a, c, t, g, unknown or other
  misc_feature (215)..(221): n is a, c, g, or t

SEQ ID NO: 106494 - DNA, 222 bp, Homo sapiens; identical to SEQ ID NO: 106398
  misc_feature: GYAE6OF02H4860.30.20.B09.1.454.CMB.1.raw
  modified_base (215)..(222): a, c, t, g, unknown or other
  misc_feature (215)..(222): n is a, c, g, or t

SEQ ID NO: 106495 - DNA, 223 bp, Homo sapiens
  misc_feature: GYAE6OF02GJTT2.30.20.B09.1.454.CMB.1.raw
  modified_base (214)..(223): a, c, t, g, unknown or other
  misc_feature (214)..(223): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctgggctgcctggtcaaggactacttccacgtagcgtgctgagcgggctggcaaggcgcatagnnnnnnnnnn

SEQ ID NO: 106496 - DNA, 215 bp, Homo sapiens; identical to SEQ ID NO: 106282
  misc_feature: GYAE6OF02IOIUF.30.20.B09.1.454.CMB.1.raw
  modified_base (214)..(215): a, c, t, g, unknown or other
  misc_feature (214)..(215): n is a, c, g, or t

SEQ ID NO: 106497 - DNA, 222 bp, Homo sapiens; identical to SEQ ID NO: 106478
  misc_feature: GYAE6OF02IH6CJ.30.20.B09.1.454.CMB.1.raw
  modified_base (214)..(222): a, c, t, g, unknown or other
  misc_feature (214)..(222): n is a, c, g, or t

SEQ ID NO: 106498 - DNA, 224 bp, Homo sapiens
  misc_feature: GYAE6OF02IAYJ2.30.20.B09.1.454.CMB.1.raw
  modified_base (214)..(224): a, c, t, g, unknown or other
  misc_feature (214)..(224): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnnnnnnn

SEQ ID NO: 106499 - DNA, 287 bp, Homo sapiens
  misc_feature: GYAE6OF02HM2T7.30.20.B09.1.454.CMB.1.raw
  modified_base (228)..(229): a, c, t, g, unknown or other
  misc_feature (228)..(229): n is a, c, g, or t
  modified_base (231)..(287): a, c, t, g, unknown or other
  misc_feature (231)..(287): n is a, c, g, or t
tcagcacgctacgtcacgaccggtgctcgatttagtgtagtgtgaagggtgccggagggaaccctgggtcaccgtctcctcagcctccaccaagggccccatacggtcttcccccgtggcaccatcctccaagagccacctcctgggggcacagcgggcccctgggcgttgcctggtcaaggctacttccacgtagcgtgctgagcgggctggcaaggccgcataggnncnnnnnnnnnnnnnnnnnnnnnnnnnnnnnnnnnnnnnnnnnnnnnnnnnnnnnnnnn

SEQ ID NO: 106500 - DNA, 214 bp, Homo sapiens; identical to SEQ ID NO: 106429
  misc_feature: GYAE6OF02FJL2G.30.20.B09.1.454.CMB.1.raw
  modified_base (214)..(214): a, c, t, g, unknown or other
  misc_feature (214)..(214): n is a, c, g, or t

SEQ ID NO: 106501 - DNA, 219 bp, Homo sapiens
  misc_feature: GYAE6OF02FJIAR.30.20.B09.1.454.CMB.1.raw
  modified_base (212)..(219): a, c, t, g, unknown or other
  misc_feature (212)..(219): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccactagcgtgctgagcgggctggcaaggcgcatagnnnnnnnn

SEQ ID NO: 106502 - DNA, 615 bp, Homo sapiens
  misc_feature: GYAE6OF02GHROK.30.20.B09.1.454.CMB.1.raw
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (406)..(406): a, c, t, g, unknown or other
  misc_feature (406)..(406): n is a, c, g, or t
tcagcacgctacgtcacgaccggtgctcgattttagtgtagtgtgaaggttggtccgagggaaccctggtcaccgtcgtccgtctagcccttccgaccaacgggacccgacttccggtcctttccccccgtggcacccatcctccaagagcacctcgtggggcacacgcggcccgtgggtcggtcgtccgtacggttcgttaacggacgttacttccctacgtttagacgttgcctgaggcgggcgttcggacgtaagggtcgcgacggtagctgcagcgtgggcngngcncncngngncgcncgctcctcngtntgtgntgcgtgcgcncncncgaggaggngtgngnggngcganananagagagngacgcgcgtagttacgtgctgtgtagacgtcgtctacnctctcgagacgacgaacgacgaacgtactacgactagtactactacacacgactacgtacgtagacgtacgtacgacgacgacgacgtacgtacgttacgttacgttacgtacgacgtagtagtagtaaggtaaacggttaagtagttacgttagtttaggtttaggttacggtacggtacggtacggtccggttaccgtaccgtcccg

SEQ ID NO: 106503 - DNA, 218 bp, Homo sapiens; identical to SEQ ID NO: 106350
  misc_feature: GYAE6OF02F0USB.30.20.B09.1.454.CMB.1.raw
  modified_base (214)..(218): a, c, t, g, unknown or other
  misc_feature (214)..(218): n is a, c, g, or t

SEQ ID NO: 106504 - DNA, 259 bp, Homo sapiens
  misc_feature: GYAE6OF02G26YM.30.20.B09.1.454.CMB.1.raw
  modified_base (223)..(259): a, c, t, g, unknown or other
  misc_feature (223)..(259): n is a, c, g, or t
tcagcacgctacgtcacgaccggtgctcgatttagtgtagtgtgaagggtggccagggaaccctggtcaccgtctcctcagcctccaccaagggcccatcggtcgttcccccctggccaccatcctccgaagagcacctctgggggcacagcggccctgggctgcctggtcaaggactacttccacgtagcgtgctcgacgcgggctgggcaaggcgcatagnnnnnnnnnnnnnnnnnnnnnnnnnnnnnnnnnnnnn

SEQ ID NO: 106505 - DNA, 265 bp, Homo sapiens
  misc_feature: GYAE6OF02FTKRU.30.20.B09.1.454.CMB.1.raw
  modified_base (218)..(265): a, c, t, g, unknown or other
  misc_feature (218)..(265): n is a, c, g, or t
tcagcacgctacgtcacgaccggtgctcgatttagtgtagtgtgaagggtggccagggaaccctggtcaccgtctcctcgagcctccaccaagggcccatcggtcttccccctggcaccatcctccaagagcacctctgggggcacagcggccctgggctgcctggtcaaggactacttccacgtagcgtgctgagcgggctggcaaggcgcagtagnnnnnnnnnnnnnnnnnnnnnnnnnnnnnnnnnnnnnnnnnnnnnnnn

SEQ ID NO: 106506 - DNA, 217 bp, Homo sapiens; identical to SEQ ID NO: 106335
  misc_feature: GYAE6OF02GQ7UK.30.20.B09.1.454.CMB.1.raw
  modified_base (214)..(217): a, c, t, g, unknown or other
  misc_feature (214)..(217): n is a, c, g, or t

SEQ ID NO: 106507 - DNA, 217 bp, Homo sapiens; identical to SEQ ID NO: 106335
  misc_feature: GYAE6OF02G7XXL.30.20.B09.1.454.CMB.1.raw
  modified_base (214)..(217): a, c, t, g, unknown or other
  misc_feature (214)..(217): n is a, c, g, or t

SEQ ID NO: 106508 - DNA, 219 bp, Homo sapiens; identical to SEQ ID NO: 106318
  misc_feature: GYAE6OF02H8GD4.30.20.B09.1.454.CMB.1.raw
  modified_base (215)..(219): a, c, t, g, unknown or other
  misc_feature (215)..(219): n is a, c, g, or t

SEQ ID NO: 106509 - DNA, 216 bp, Homo sapiens; identical to SEQ ID NO: 106284
  misc_feature: GYAE6OF02I61KA.30.20.B09.1.454.CMB.1.raw
  modified_base (214)..(216): a, c, t, g, unknown or other
  misc_feature (214)..(216): n is a, c, g, or t

SEQ ID NO: 106510 - DNA, 220 bp, Homo sapiens
  misc_feature: GYAE6OF02JG72R.30.20.B09.1.454.CMB.1.raw
  modified_base (213)..(220): a, c, t, g, unknown or other
  misc_feature (213)..(220): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnnn

SEQ ID NO: 106511 - DNA, 217 bp, Homo sapiens; identical to SEQ ID NO: 106257
  misc_feature: GYAE6OF02GPJ04.30.20.B09.1.454.CMB.1.raw
  modified_base (213)..(217): a, c, t, g, unknown or other
  misc_feature (213)..(217): n is a, c, g, or t

SEQ ID NO: 106512 - DNA, 216 bp, Homo sapiens; identical to SEQ ID NO: 106259
  misc_feature: GYAE6OF02GJRCG.30.20.B09.1.454.CMB.1.raw
  modified_base (213)..(216): a, c, t, g, unknown or other
  misc_feature (213)..(216): n is a, c, g, or t

SEQ ID NO: 106513 - DNA, 218 bp, Homo sapiens; identical to SEQ ID NO: 106350
  misc_feature: GYAE6OF02GDUXG.30.20.B09.1.454.CMB.1.raw
  modified_base (214)..(218): a, c, t, g, unknown or other
  misc_feature (214)..(218): n is a, c, g, or t

SEQ ID NO: 106514 - DNA, 215 bp, Homo sapiens; identical to SEQ ID NO: 106266
  misc_feature: GYAE6OF02GI8WG.30.20.B09.1.454.CMB.1.raw
  modified_base (213)..(215): a, c, t, g, unknown or other
  misc_feature (213)..(215): n is a, c, g, or t

SEQ ID NO: 106515 - DNA, 218 bp, Homo sapiens; identical to SEQ ID NO: 106294
  misc_feature: GYAE6OF02IXAQD.30.20.B09.1.454.CMB.1.raw
  modified_base (213)..(218): a, c, t, g, unknown or other
  misc_feature (213)..(218): n is a, c, g, or t

SEQ ID NO: 106516 - DNA, 217 bp, Homo sapiens; identical to SEQ ID NO: 106287
  misc_feature: GYAE6OF02HPLEY.30.20.B09.1.454.CMB.1.raw
  modified_base (215)..(217): a, c, t, g, unknown or other
  misc_feature (215)..(217): n is a, c, g, or t

SEQ ID NO: 106517 - DNA, 221 bp, Homo sapiens
  misc_feature: GYAE6OF02HIDQB.30.20.B09.1.454.CMB.1.raw
  modified_base (213)..(221): a, c, t, g, unknown or other
  misc_feature (213)..(221): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccagtagcgtgctgagcgggctggcaaggcgcatagnnnnnnnnn

SEQ ID NO: 106518 - DNA, 217 bp, Homo sapiens
  misc_feature: GYAE6OF02IFI5O.30.20.B09.1.454.CMB.1.raw
  modified_base (214)..(217): a, c, t, g, unknown or other
  misc_feature (214)..(217): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggcttcctggtcaaggactacttccacgtagcgtgctgagcgggctggcaaggcgcatagnnnn

SEQ ID NO: 106519 - DNA, 222 bp, Homo sapiens; identical to SEQ ID NO: 106398
  misc_feature: GYAE6OF02FWKWF.30.20.B09.1.454.CMB.1.raw
  modified_base (215)..(222): a, c, t, g, unknown or other
  misc_feature (215)..(222): n is a, c, g, or t

SEQ ID NO: 106520 - DNA, 252 bp, Homo sapiens
  misc_feature: GYAE6OF02HAMOV.30.20.B09.1.454.CMB.1.raw
  modified_base (223)..(252): a, c, t, g, unknown or other
  misc_feature (223)..(252): n is a, c, g, or t
tcagcacgctacgtcacgaccggtgctcgatttagtgtagtgtgaagggtggccgagggaaccctggtcaccgtctcctcagcctccaccaagggcccatcggtcttccccctggcaccatcctccaagacgcacctctgggggcacagccggccctgggctgcctggtcaaggactacttccacgtagccgtgcttgacgcgggctggccaaggcgcatagnnnnnnnnnnnnnnnnnnnnnnnnnnnnnn

SEQ ID NO: 106521 - DNA, 215 bp, Homo sapiens; identical to SEQ ID NO: 106282
  misc_feature: GYAE6OF02HU6NS.30.20.B09.1.454.CMB.1.raw
  modified_base (214)..(215): a, c, t, g, unknown or other
  misc_feature (214)..(215): n is a, c, g, or t

SEQ ID NO: 106522 - DNA, 216 bp, Homo sapiens
  misc_feature: GYAE6OF02GWSRN.30.20.B09.1.454.CMB.1.raw
  modified_base (214)..(216): a, c, t, g, unknown or other
  misc_feature (214)..(216): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagcggccctggactgcctggtcaaggactacttccacgtagcgtgctgagcgggctggcaaggcgcatagnnn

SEQ ID NO: 106523 - DNA, 222 bp, Homo sapiens
  misc_feature: GYAE6OF02GYSHP.30.20.B09.1.454.CMB.1.raw
  modified_base (214)..(222): a, c, t, g, unknown or other
  misc_feature (214)..(222): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggccctgggctgcctggtcaaggactacttccacgtagcgtgctgagcgggctggcaaggcgcatagnnnnnnnnn

SEQ ID NO: 106524 - DNA, 215 bp, Homo sapiens; identical to SEQ ID NO: 106288
  misc_feature: GYAE6OF02G3KCL.30.20.B09.1.454.CMB.1.raw
  modified_base (214)..(215): a, c, t, g, unknown or other
  misc_feature (214)..(215): n is a, c, g, or t

SEQ ID NO: 106525 - DNA, 220 bp, Homo sapiens
  misc_feature: GYAE6OF02HHYNQ.30.20.B09.1.454.CMB.1.raw
  modified_base (215)..(220): a, c, t, g, unknown or other
  misc_feature (215)..(220): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctcgtgggggcacagcggccctgggctgcctggtcaaggactacttccacgtagcgtgctgagcgggctggcaaggcgcatagnnnnnn

SEQ ID NO: 106526 - DNA, 224 bp, Homo sapiens
  misc_feature: GYAE6OF02I3CXE.30.20.B09.1.454.CMB.1.raw
  modified_base (213)..(224): a, c, t, g, unknown or other
  misc_feature (213)..(224): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnnnnnnn

SEQ ID NO: 106527 - DNA, 279 bp, Homo sapiens
  misc_feature: GYAE6OF02FVXQY.30.20.B09.1.454.CMB.1.raw
  modified_base (221)..(221): a, c, t, g, unknown or other
  misc_feature (221)..(221): n is a, c, g, or t
  modified_base (226)..(279): a, c, t, g, unknown or other
  misc_feature (226)..(279): n is a, c, g, or t
tcagcacgctacgtcacgaccggtgctcgatttagtgtagtgtgaagggtgtccgagggaaccctggtccaccgtctcctcagcctccaccaagggcccatcggtcgttcccccctggcaccatccctccgaagagcacctctgggggcacgagccggcccgtgggctgcctggtcaaggactacttccacgtagcgtgctgacgcgggctggcaaggcgnatagnnnnnnnnnnnnnnnnnnnnnnnnnnnnnnnnnnnnnnnnnnnnnnnnnnnnnn

SEQ ID NO: 106528 - DNA, 218 bp, Homo sapiens; identical to SEQ ID NO: 106350
  misc_feature: GYAE6OF02F7EOU.30.20.B09.1.454.CMB.1.raw
  modified_base (214)..(218): a, c, t, g, unknown or other
  misc_feature (214)..(218): n is a, c, g, or t

SEQ ID NO: 106529 - DNA, 294 bp, Homo sapiens
  misc_feature: GYAE6OF02FU5U1.30.20.B09.1.454.CMB.1.raw
  modified_base (207)..(207): a, c, t, g, unknown or other
  misc_feature (207)..(207): n is a, c, g, or t
  modified_base (213)..(214): a, c, t, g, unknown or other
  misc_feature (213)..(214): n is a, c, g, or t
  modified_base (217)..(218): a, c, t, g, unknown or other
  misc_feature (217)..(218): n is a, c, g, or t
  modified_base (227)..(227): a, c, t, g, unknown or other
  misc_feature (227)..(227): n is a, c, g, or t
  modified_base (229)..(294): a, c, t, g, unknown or other
  misc_feature (229)..(294): n is a, c, g, or t
tcagcacgctacgtcacgaccggtgctcgatttagtgtagtgtgaagggtgccgagggaaccctggtcaccgtctcctcagcctccaccaagggcccatcggtcttccccctggcaccatcctccaagagcacctctggggcaccagcggccctggctgcctggtcaaggctattccacgtagcgtgctgagcgggctggcaaggcncatagnngcnnctgatcagncnnnnnnnnnnnnnnnnnnnnnnnnnnnnnnnnnnnnnnnnnnnnnnnnnnnnnnnnnnnnnnnnnn

SEQ ID NO: 106530 - DNA, 219 bp, Homo sapiens; identical to SEQ ID NO: 106458
  misc_feature: GYAE6OF02HB1P5.30.20.B09.1.454.CMB.1.raw
  modified_base (214)..(219): a, c, t, g, unknown or other
  misc_feature (214)..(219): n is a, c, g, or t

SEQ ID NO: 106531 - DNA, 218 bp, Homo sapiens; identical to SEQ ID NO: 106308
  misc_feature: GYAE6OF02FL5TA.30.20.B09.1.454.CMB.1.raw
  modified_base (215)..(218): a, c, t, g, unknown or other
  misc_feature (215)..(218): n is a, c, g, or t

SEQ ID NO: 106532 - DNA, 281 bp, Homo sapiens
  misc_feature: GYAE6OF02HN6GQ.30.20.B09.1.454.CMB.1.raw
  modified_base (222)..(222): a, c, t, g, unknown or other
  misc_feature (222)..(222): n is a, c, g, or t
  modified_base (228)..(236): a, c, t, g, unknown or other
  misc_feature (228)..(236): n is a, c, g, or t
  modified_base (238)..(281): a, c, t, g, unknown or other
  misc_feature (238)..(281): n is a, c, g, or t
tcagcacgctacgtcacgaccggtgctcgatttagtgtagtgtgaagggtgtccgagggaaccctggtccaccgtctcctcagcctccaccaagggcccatcggtcgttcccccctggccaccatccctccgaagacgcacctcgtgggggcacgagccggccctgggctgcctggtcaaggactacttccacgtagcgtgctgagcgggctggcaaggcgnagtagnnnnnnnnngnnnnnnnnnnnnnnnnnnnnnnnnnnnnnnnnnnnnnnnnnnnn

SEQ ID NO: 106533 - DNA, 215 bp, Homo sapiens; identical to SEQ ID NO: 106266
  misc_feature: GYAE6OF02F8FME.30.20.B09.1.454.CMB.1.raw
  modified_base (213)..(215): a, c, t, g, unknown or other
  misc_feature (213)..(215): n is a, c, g, or t

SEQ ID NO: 106534 - DNA, 223 bp, Homo sapiens
  misc_feature: GYAE6OF02I8B36.30.20.B09.1.454.CMB.1.raw
  modified_base (214)..(223): a, c, t, g, unknown or other
  misc_feature (214)..(223): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggctacttccacgtagcgtgctgagcgggctggcaaggcgcatagnnnnnnnnnn

SEQ ID NO: 106535 - DNA, 224 bp, Homo sapiens; identical to SEQ ID NO: 106498
  misc_feature: GYAE6OF02HJMUI.30.20.B09.1.454.CMB.1.raw
  modified_base (214)..(224): a, c, t, g, unknown or other
  misc_feature (214)..(224): n is a, c, g, or t

SEQ ID NO: 106536 - DNA, 221 bp, Homo sapiens
  misc_feature: GYAE6OF02IVR96.30.20.B09.1.454.CMB.1.raw
  modified_base (212)..(221): a, c, t, g, unknown or other
  misc_feature (212)..(221): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaggcgcatagnnnnnnnnnn

SEQ ID NO: 106537 - DNA, 223 bp, Homo sapiens
  misc_feature: GYAE6OF02F2XD5.30.20.B09.1.454.CMB.1.raw
  modified_base (213)..(223): a, c, t, g, unknown or other
  misc_feature (213)..(223): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctggggcacagcggccctgggctgcctggtcaaggactacttccacgtagcgtgctgagcgggctggcaaggcgcatagnnnnnnnnnnn

SEQ ID NO: 106538 - DNA, 221 bp, Homo sapiens
  misc_feature: GYAE6OF02HSQK4.30.20.B09.1.454.CMB.1.raw
  modified_base (214)..(221): a, c, t, g, unknown or other
  misc_feature (214)..(221): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccatgggctgcctggtcaaggactacttccacgtagcgtgctgagcgggctggcaggcgcatagnnnnnnnn

SEQ ID NO: 106539 - DNA, 230 bp, Homo sapiens
  misc_feature: GYAE6OF02F7P9J.30.20.B09.1.454.CMB.1.raw
  modified_base (215)..(230): a, c, t, g, unknown or other
  misc_feature (215)..(230): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnnnnnnnnnn

SEQ ID NO: 106540 - DNA, 227 bp, Homo sapiens
  misc_feature: GYAE6OF02H97BO.30.20.B09.1.454.CMB.1.raw
  modified_base (212)..(227): a, c, t, g, unknown or other
  misc_feature (212)..(227): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctggggcacagcggcccttggctgcctggtcaaggactacttccacgtagcgtgctgagcgggctggcagcgcatagnnnnnnnnnnnnnnnn

SEQ ID NO: 106541 - DNA, 254 bp, Homo sapiens
  misc_feature: GYAE6OF02FHON2.30.20.B09.1.454.CMB.1.raw
  modified_base (216)..(218): a, c, t, g, unknown or other
  misc_feature (216)..(218): n is a, c, g, or t
  modified_base (220)..(221): a, c, t, g, unknown or other
  misc_feature (220)..(221): n is a, c, g, or t
  modified_base (223)..(254): a, c, t, g, unknown or other
  misc_feature (223)..(254): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcaccctctgggggcaccagcggccctgggctgcctggtcaaggctacttccacgtagcgtgctgagcgggctggcaaggcgcatagnnncnntnnnnnnnnnnnnnnnnnnnnnnnnnnnnnnnn

SEQ ID NO: 106542 - DNA, 327 bp, Homo sapiens
  misc_feature: GYAE6OF02J3E99.30.20.B09.1.454.CMB.1.raw
  modified_base (250)..(250): a, c, t, g, unknown or other
  misc_feature (250)..(250): n is a, c, g, or t
  modified_base (258)..(327): a, c, t, g, unknown or other
  misc_feature (258)..(327): n is a, c, g, or t
tcagcacgctacgtcacgaccggtgctcgatttagtgtagtgtgaagggtgccagggaaccctggtcaccgtctcctcagcctccaccaagggcccatcggtccttccccctggccaccatcctaccaagcgccaccctcgtgggggccacaggccggccccgtggggcctcgcccgtggtacgaacggacctaccttcccgacggtagccgtgccgtggacgggcgggtccgtggaccgaaggcccganaagtgcgnnnnnnnnnnnnnnnnnnnnnnnnnnnnnnnnnnnnnnnnnnnnnnnnnnnnnnnnnnnnnnnnnnnnnn

SEQ ID NO: 106543 - DNA, 233 bp, Homo sapiens
  misc_feature: GYAE6OF02H3ALO.30.20.B09.1.454.CMB.1.raw
  modified_base (215)..(233): a, c, t, g, unknown or other
  misc_feature (215)..(233): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnnnnnnnnnnnnn

SEQ ID NO: 106544 - DNA, 220 bp, Homo sapiens; identical to SEQ ID NO: 106347
  misc_feature: GYAE6OF02HDD1I.30.20.B09.1.454.CMB.1.raw
  modified_base (214)..(220): a, c, t, g, unknown or other
  misc_feature (214)..(220): n is a, c, g, or t

SEQ ID NO: 106545 - DNA, 242 bp, Homo sapiens
  misc_feature: GYAE6OF02G4GZB.30.20.B09.1.454.CMB.1.raw
  modified_base (217)..(242): a, c, t, g, unknown or other
  misc_feature (217)..(242): n is a, c, g, or t
tcagcacgctacgtcacgaccggtgctcgatttagtgtagtgtgaagggtgtcagggaaccctggtcaccgtctcctcagcctccaccaagggcccatcggtcttccccctggcaccatccctccaaagagcacctcgtggggcacagcggccctgggctgcctggtcaaggactacttcacgtagcgtgctgagcgggctggacaaggcgcatagnnnnnnnnnnnnnnnnnnnnnnnnnn

SEQ ID NO: 106546 - DNA, 218 bp, Homo sapiens; identical to SEQ ID NO: 106275
  misc_feature: GYAE6OF02GVTBM.30.20.B09.1.454.CMB.1.raw
  modified_base (214)..(218): a, c, t, g, unknown or other
  misc_feature (214)..(218): n is a, c, g, or t

SEQ ID NO: 106547 - DNA, 227 bp, Homo sapiens
  misc_feature: GYAE6OF02FO2YO.30.20.B09.1.454.CMB.1.raw
  modified_base (215)..(227): a, c, t, g, unknown or other
  misc_feature (215)..(227): n is a, c, g, or t
tcagcacgctacgtcacgaccggtgctcgatttagtgtagtgtgaagggtgccagggaaccctggtcaccgtctcctcagcctccaccaagggcccatcggtcttccccctggcacatcctccaagagcacctctgggggcacagcggccctgggctgcctggtcaaggactacttccacgtagcgtgctgagcgggctggcaaggcgcaatagnnnnnnnnnnnnn

SEQ ID NO: 106548 - DNA, 223 bp, Homo sapiens
  misc_feature: GYAE6OF02FOO65.30.20.B09.1.454.CMB.1.raw
  modified_base (215)..(223): a, c, t, g, unknown or other
  misc_feature (215)..(223): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagcggccctgggctgcctggtcaaggactacttccacgtagcgtgctgagcgggctggcaaggcgcatagnnnnnnnnn

SEQ ID NO: 106549 - DNA, 219 bp, Homo sapiens
  misc_feature: GYAE6OF02II8TT.30.20.B09.1.454.CMB.1.raw
  modified_base (212)..(219): a, c, t, g, unknown or other
  misc_feature (212)..(219): n is a, c, g, or t
tcagcacgctacgtcacgaccggtgctcgatttagtgtagtgtgaagggtgccagggaaccctggtcaccgtctcctcagcctccaccaaggcccatcggtcttcccctggcaccatcctccaagagcacctgtgggggcacagcggccctgggctgcctggtcaaggctacttccacgtgcgtgctgaggcgggctggcaaggcgcatagnnnnnnnn

SEQ ID NO: 106550 - DNA, 242 bp, Homo sapiens
  misc_feature: GYAE6OF02I9Q04.30.20.B09.1.454.CMB.1.raw
  modified_base (215)..(242): a, c, t, g, unknown or other
  misc_feature (215)..(242): n is a, c, g, or t
tcagcacgctacgtcacgaccggtgctcgatttagtgtagtgtgaagggtgccagggaaccctggtcaccgtctcctcagcctccaccaagggcccatcggtcttccccctggcaccatcctccaagagcacctctgggggcacagtggccctgggctgcctggtcaaggactacttccacgtagcgtgctgagcgggctggcaaggcgcatagnnnnnnnnnnnnnnnnnnnnnnnnnnnn

SEQ ID NO: 106551 - DNA, 218 bp, Homo sapiens; identical to SEQ ID NO: 106350
  misc_feature: GYAE6OF02FLZA0.30.20.B09.1.454.CMB.1.raw
  modified_base (214)..(218): a, c, t, g, unknown or other
  misc_feature (214)..(218): n is a, c, g, or t

SEQ ID NO: 106552 - DNA, 232 bp, Homo sapiens
  misc_feature: GYAE6OF02HMXJN.30.20.B09.1.454.CMB.1.raw
  modified_base (215)..(232): a, c, t, g, unknown or other
  misc_feature (215)..(232): n is a, c, g, or t
tcagcacgctacgtcacgaccggtgctcgatttagtgtagtgtgaagggtgccagggaaccctggtcaccgtctcctcagcctccaccaagggcccatcggtccttccccctggcaccatcctccaagagcacctctgggggcacagcggccctgggctgcctggtcaaggactactccacgtagcgtgctgagcgggctggcaaggcgcatagnnnnnnnnnnnnnnnnnn

SEQ ID NO: 106553 - DNA, 247 bp, Homo sapiens
  misc_feature: GYAE6OF02FKK0E.30.20.B09.1.454.CMB.1.raw
  modified_base (217)..(247): a, c, t, g, unknown or other
  misc_feature (217)..(247): n is a, c, g, or t
tcagcacgctacgtcacgaccggtgctcgatttagtgtagtgtgaagggtgccgaggggaaccctggtcaccgtctcctcagcctccaccaagggcccatcggtcttcccctggcaccatcctccaagagcacctctgggggcaccagcggccctgggctgcctggtcaaggctacttccacgtagcgtgctgagcgggctgggcaaggcgcatagnnnnnnnnnnnnnnnnnnnnnnnnnnnnnnn

SEQ ID NO: 106554 - DNA, 224 bp, Homo sapiens
  misc_feature: GYAE6OF02GAV3K.30.20.B09.1.454.CMB.1.raw
  modified_base (215)..(224): a, c, t, g, unknown or other
  misc_feature (215)..(224): n is a, c, g, or t
tcagcacgctacgtcacgaccggtgctcgatttagtgtagtgtgaagggtgccagggaaccctggtcaccgtctcctcagcctccaccaagggcccatcggtcttcccctggcaccatcctccaagagcacctctgggggcacagccggccctgggctgcctggtcaaggactacttccacgtagcgtgctgagcgggctggcaaggcgcatagnnnnnnnnnn

SEQ ID NO: 106555 - DNA, 509 bp, Homo sapiens
  misc_feature: GYAE6OF01AXBCY.13.71.G05.1.454.CMB.1.raw
  modified_base (417)..(417): a, c, t, g, unknown or other
  misc_feature (417)..(417): n is a, c, g, or t
tcagtcacgtactacacgaccggtgctcgatttagtgtcgtcgcaagagagaggggggggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctcgaccatcagccggacccaggctatggatgaggctgactatactgtcgaggcgtggacagcagcacgtcgcccgntacgtcgttacgtcggacgtcgggaccaggtccaccgtacgtacgtcacgacccgaacgaccccaaccctctcgacacctcgtcgtaccccc

SEQ ID NO: 106556 - DNA, 532 bp, Homo sapiens
  misc_feature: GYAE6OF01DQK6C.13.71.G05.1.454.CMB.1.raw
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagcgtggtttccgtgtagctatttagaaggtgtccagtgtgaggtgcagctggtggagtcgtggggggggcttggtccaggcctggggggtccctgagactctcctgtgcagcctctggattcattttagaggttattggatgggttgggtccgccagactccagagaagggactgggagtgggtggccaanataaaaggaagatgggaagtagaaagatactatgtggactntggtgaagggccgattcaccatctcagagacaacgccaaagactcactgtaatctgcagatgaccagccgtgagagtcgaggatacgggctgtgttattattgtgcgagagagtggggacacggtacgattttgaaggtggtgtacgtggggccaggggacccgg

SEQ ID NO: 106557 - DNA, 523 bp, Homo sapiens
  misc_feature: GYAE6OF01B7OMM.13.71.G05.1.454.CMB.1.raw
  modified_base (425)..(425): a, c, t, g, unknown or other
  misc_feature (425)..(425): n is a, c, g, or t
  modified_base (492)..(492): a, c, t, g, unknown or other
  misc_feature (492)..(492): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagcgtggtttcgtgtaggcgtatttagaaggtgtcagtgtgaggtgcagctgacggagtctggaggagacttggtccaggccgggggggtcctgagactctcctgcatagtctcaagatttatgttcagtaattattggatgagctgggtccgccaggctccgaggggaagggctggagtgggtggccaacataaagcacgatggaagtgagaaacagtatgtggagtctgtgagggccattcaccatctccagagacaacgccaaagaactcactgtatctgcagatgancagcctggagaggcgaggacacggctaggtatagttacgtgtcggagtaagggtaattcttttaacntagtataggttagttcggttaactccgtacg

SEQ ID NO: 106558 - DNA, 545 bp, Homo sapiens
  misc_feature: GYAE6OF01AI34L.13.71.G05.1.454.CMB.1.raw
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggagtggggatcatctatcctggtgactctgataccagatacagcccgtccttccaaggccaggtcaccatctcagccgacaagtccatcagcaccgcctactgcagtgagcagcctgaagccctcggaccaccgcatgtattactgtcgacaaatacgcatactacgtaattcacgtcttactactacaacgtatggacgttcgcgggaccaggaccacggtcaccgtcctccgtcacgccctccgaccgaacgggccctacgtcccggtaccttcccccgtggccctaccccg

SEQ ID NO: 106559 - DNA, 651 bp, Homo sapiens
  misc_feature: GYAE6OF01DND0G.13.71.G05.1.454.CMB.1.raw
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgacccgggaagcctggagtggatggggatcatctatcctggtgactctgataccagatacacgcccgtccttccaaggccaggtcaccatctcagccgacaacgtccatcacgccaccgcctacctgcagtggacgcacgcctggaacggtccctacggaccaccgacctagtcgtaattacgtgtacgaactaaaataccgactaacttaaccgtaacggttaattaccgaaccggtctttaacctaacgttaaccgtaacggttacgtacgggtaccgttaccgtacgggggtaacccgaacggggaaccccgtaccgggtaccaaccccggttcctaccccgtcaaccgtccctacccgaacccgaaccgggtcccctacgtacccggttcccttcccccgtcggcccctaacccccg

SEQ ID NO: 106560 - DNA, 621 bp, Homo sapiens
  misc_feature: GYAE6OF01C5RYG.13.71.G05.1.454.CMB.1.raw
  modified_base (140)..(140): a, c, t, g, unknown or other
  misc_feature (140)..(140): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagcggngtttcgtgtaggcgtactttagaaggtgtcagtgtgaggtgcagctgacggagtctggaggagacttggccaggccggggggtcctgagctctcctgcatagtctcaagtatttatgttcagtaattattggatgngctggcgcaggctcgaggagggntggagtggnggcacaanaaganacgagagagagaagaanagtagtagtgtagtgtagtaggaggacgtacgtacacactactaccgaagacgaaccgaaccgaaccgaaacgaacgtacgtaactacgtactacgtacgacgagacgtagacgacgacgacgtaggaggacgggacggacggacgacggtacgtacgttaagttaacgttacgttcggtacggtacgggtaagggttaaacggtttaacgttttacgtttacgttaaggttaaggttaaggttaacggtttaaccggtttaacccgtttaacccgttaaccg

SEQ ID NO: 106561 - DNA, 650 bp, Homo sapiens
  misc_feature: GYAE6OF01DD2YD.13.71.G05.1.454.CMB.1.raw
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagtctttatcagccactggatcggctgggtgcgccagatggacccgggaaaggcctggagtggagtggggatcatctatcctggtgactctgataccagatacacgcccgtccttaccgaaggcccaggtccaaccgatcctcagccgacaacgtccatcagccaccgcctactgcagtgagcagctagacgctcgacaccgcatcgtatacgtgtagaactaaactcgactaacttacgtaacgtaacttaccgaaccggtacctttaaccgtaactaaccgtaacggtacgtacgggtaccggttacggtacgggaacccgtaacgggacccgtaccggttccaaccccggttctacccgtacgaccgtacccctacccgaaacccggtaacccgggtccccgtaacggttccccggttaccccgtttccccccgtcggtcccccgtaaccccccg

SEQ ID NO: 106562 - DNA, 751 bp, Homo sapiens
  misc_feature: GYAE6OF01CC39C.13.71.G05.1.454.CMB.1.raw
tcagtcacgtactacacgaccggtgctcgatttagtgtcgtcgcaagagagaggggggggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtccctgtgcttggtcatctatcaagatgaccaagccggccctcgagggactcccgtgagcgtattctcgtcggccttacccaacttccgtacggggaaaccttccgaacgccctaaccgttcctacggaaccctacgtaccgacgggacccggggtaaccccagggtaccttaaggtacgggaagttacgggaacgggtaccttacgggtaacctttaacgtttaaccgttggtaccggaacggggtccggttacggggaacgacggccgtaaacggcctaaccgtccggacccccggtacttaacgttaccgggtttaccgtttaccggggaaaccgttccgggggaaaccccttaaagggggtccccgttaaaccccggttacccgttaaaacgggttcccgaaaacccgggtaccccccgaaaacggggtaccccccctaaaacccccgtacgttacccggtacctacccctttccggttaccccgtttaaccccccc

SEQ ID NO: 106563 - DNA, 744 bp, Homo sapiens
  misc_feature: GYAE6OF01BZAU9.13.71.G05.1.454.CMB.1.raw
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagtctttatcagccactggatcggctgggtgcgccagatggacccgggaaaggcctggagtggagtggggatcgatctatccgtggtgactctgactaccagactaccgacgccccgtccttaccgaacggtcccaggtccaacctatcctacacgccgaacaacgtccatccgacgccacccgcctacctgacaggtcggagcacgcccgtaggaaccggcccgtacgggaacccacccggacctattacgttaacttacgtggtaacgaactaaaacgttaccgacaaagttaaccgtaaccgggttaaacttcccggaacccggttactttaaacctaaccgttaacgtaaaccgggttagtacgggtaccgttacgggtaccggggtaacccggaaacggggtaaccccgtaaccgggttacccgaaccccggttacccttaccccgtaccaaccggtccccgtaccccgaacccggtaaacccgggcccccgtaacgttcccccgggttaccccctttccccccgtccgggtcccctaacccccccg

SEQ ID NO: 106564 - DNA, 608 bp, Homo sapiens
  misc_feature: GYAE6OF01CW07I.13.71.G05.1.454.CMB.1.raw
  modified_base (367)..(367): a, c, t, g, unknown or other
  misc_feature (367)..(367): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtggggggggcttggtccagccgtggggggtccctgagactctcctgtgcagcctctggattcactttttagtaggttattgggatggggttggtccgccagacctcaggagaaggggctggaggtgggtggaccaaacagtaaaaggaagagtagggaagtagaaaagntaactagtgtagggactcgtgtagaaggggcctaatttcacctatcctaccagagacaacgaccaagaactcactgtatctgacagatgaaccagcctagagacgtcggaaggtacgtacgggtctggttgttaatttagttcgtaggtacggagtaggtaggtcggggacaacggtaacgttagtttttaggaggttagggttacgttacggtcgggggtacccggagggggtaacccgg

SEQ ID NO: 106565 - DNA, 508 bp, Homo sapiens
  misc_feature: GYAE6OF01ESOKM.13.71.G05.1.454.CMB.1.raw
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgctattttagaaggtgtccagtgtgaggtgcagctgacggagtctggaggagacttggtccagccgggggggtccctgagactctcctgcatagtctcaagatttatgttcagtaattattggatgagctgggtccgccaggctccaggggagggctgggagtgggtggccaacataaagcacgatggaagtgaagaaacagtatgtggagtctgtgaagggccgattcaccatctcagagacaacgcaagaactcactgatctgcagatgagcagcctgagaggcaggacacggctgtatattacgngtgcgagggaattnttttacntagattaggtagttggttacncctacg

SEQ ID NO: 106566 - DNA, 627 bp, Homo sapiens
  misc_feature: GYAE6OF01EXJN6.13.71.G05.1.454.CMB.1.raw
  modified_base (402)..(402): a, c, t, g, unknown or other
  misc_feature (402)..(402): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctcgggtccgccgaggcctccgaggggaaggggctgggagtgcgttcttcttttatttatagtagtggtagtactatactccgcacgcgtcggtggacggggccattcaccatctcaganacaacttccaagaaccacgtcttgtttactacaaatcgaaacngcctagganacgaccgatacgaaccgaccggtctagttattacgtggtacgcgaaggacgtacggtacccggggacccctaaacgggttaaaccgttaccgtaaccggaccgttaaggtaccggggtaaccggttccgggtacgggggaaccccggtaaacgggggaccccgtaacccgggg

SEQ ID NO: 106567 - DNA, 681 bp, Homo sapiens
  misc_feature: GYAE6OF01EQ1HC.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgctattttagaaggtgtccagtgtgaggtgcagctgacggagtctggaggagacttggtccaggccggggggtccctgagactctcctgcatagtctacaagtatttatgttcaagttaattagttggattgagcgtgggtcccgccaggctaccggaggggaaggggcgtggggaggttggggtcggacccaaacgaagtaaaacggcaacggaagtagggaaagtggaaagaaaacgtagtagtggtggagtcgtggtaggaaacgggtccgtaacttcaacctatcctaccaaggacgaacaacgaccgaaagaactcaactgtaactctagactagactggacgctaacggcctagggaacggacgggaccggtaaggaacccgacgggtacgttaggttaattaacgtttaccggtggttacgggacgggtaaaggggttaactttaacgtttttaccgtacgttaggtaacgtttaacgggtttaggtttacgggtttaaacccctacccgggtttaaacccg

SEQ ID NO: 106568 - DNA, 780 bp, Homo sapiens
  misc_feature: GYAE6OF01CHQ1U.13.71.G05.1.454.CMB.1.raw
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattgggctgagctggtttccttgtgctatttagagtgtccagtgtggngtngngtgaggagtcgtgaggagacgtagtcgacggccggggtccgggtcgagacgtcctccgtcgtcacgtagtcgtactaacgtaagtttatttagttacgttaacgttaagtttaagttaggtagtagtaggtcgtcgggttccggtacccgacggtacgtcccggtacggggaaaggggcggtggtagggtacgggtacgggaccgaaccgaaagtaaacgtaacgacgtaacggtaaggtaaggagtaacggaaagtaacgtaaggttaggtaggtaggtcgtaggtaggtaacgggacggtacttacgtacctaacgtaccgtacgaaccgaagtaacctaacttaaccgtaaccgaaacgtaaccgttcgttagttttacgttacaaaagttacgaacgtaacgcgtacgtaaggaaccgtcgtaactaggtacccgaaccgggtccgttaagttagttaaccgttaggccgtaagggtaacggtaggtaaaccggggtcccggggtaacccgaaacccttaaacgggttaacccgttaccgacgtttaggtacgggtaccggtaccggttacggggacccgggaaacccggtaacccggg

SEQ ID NO: 106569 - DNA, 734 bp, Homo sapiens
  misc_feature: GYAE6OF01AI25V.13.71.G05.1.454.CMB.1.raw
  modified_base (243)..(243): a, c, t, g, unknown or other
  misc_feature (243)..(243): n is a, c, g, or t
  modified_base (285)..(285): a, c, t, g, unknown or other
  misc_feature (285)..(285): n is a, c, g, or t
  modified_base (535)..(535): a, c, t, g, unknown or other
  misc_feature (535)..(535): n is a, c, g, or t
tcagtcacgtactacacgaccggtgctcgatttagtgtcgtcgcaagagagaggagccttagccctggactccaaggcctttccaccttggtgatcagcactgagcacagaggactcaccatggaattggggctgagctgggttttccttgttgctattttaaaggtgcccagtgtgaggtgcagctggtggagtctggaggaggcttggatcagccgtggggggtccctgagactctcctgngcagcctcgtgggttcaccgtcagtcacgtacctacatgacncgtcgggtcccgccgaggccgtaccgagggggaacgggcgtcgggagtcggccgttctttacttttatttacgtagtttaaggtggttaacgtacgtattaccgtccacgacgtacgtcccgtagggacggggctaacgttccacgacttcgtaccagtacgaccaagttaccctaaggaactccgtactttcgttttcctaacgtaaactagtaacctacggtcctaggaacggtacgacccggttaanacggtaacccggtaccggggtaccctttagttaacgttaccctttagggtaccggacggacgttaaacgggtaacggggtcccgggggtaccccaaaccggtttaaacccggttaccttaacccgggtagttacccggttaaccggggacccgttacggggttacccggggggaccctaaaacggggggaaccccccgg

SEQ ID NO: 106570 - DNA, 564 bp, Homo sapiens
  misc_feature: GYAE6OF01CUVOA.13.71.G05.1.454.CMB.1.raw
  modified_base (443)..(443): a, c, t, g, unknown or other
  misc_feature (443)..(443): n is a, c, g, or t
tcagtcacgtactacacgaccggtgctcgatttagtgtcgtcgcaagagagagggggggggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagagtcaggccagtcccctgtgctggtcatctatcaagatgccaagcgccctcgagggactcccgtgacgcgattctctcggctccactctgtcgaactcacgccactctcgaccatccgacggccgggacccaggtctagtggatggaagtctagaacttattactgtacgagggtcggtagggacagcgaagccacgtcgcccgtnttacgttcgtccgttacgggaacgtcgggaacctaagggtcctaacccggttcctaaggtccgaacgacccccgaaacggaccccaaaccccgattaccgtacctccgttccgttaccccg

SEQ ID NO: 106571 - DNA, 552 bp, Homo sapiens
  misc_feature: GYAE6OF01EOL9Y.13.71.G05.1.454.CMB.1.raw
  modified_base (330)..(330): a, c, t, g, unknown or other
  misc_feature (330)..(330): n is a, c, g, or t
  modified_base (454)..(454): a, c, t, g, unknown or other
  misc_feature (454)..(454): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccganaagtccatcagccaccgcctacctgcagtggagcagcctgaacggcctacggacaccgccatgtattactgtgacaaaatacgcaatactaacgtaattcgaccgtcttactactacaacgtanggtacgtcgtgggaccaagggacccacggtaccaccgtctccctcagcctcccaccgaacggccctagtcccggtccttcccccgtggcctacccccg

SEQ ID NO: 106572 - DNA, 737 bp, Homo sapiens
  misc_feature: GYAE6OF01B741F.13.71.G05.1.454.CMB.1.raw
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatcggaccccggggaaaggcctgggagtggagtggggatcatctatcctggtgactctgactaccgagactacacgcccgtctaccaaggccaggtccaccatctcacgccgaacaacgtccatcacgccaccgtcctaccgtcgacgacggtcggagtaccgacgtaccgtaggaaccggtccccgtaccgggaaccacccgacctaacgttacggttaactttacgtacggttaacgaaaccgtaaaaacgttaccgacctaaacgttaaccgttaaaccggttaacttacccggaacccggttactttaacccgtaactaaccgtaaacgggttagtacgggtaccgttacgggtaccggggaaccgaacggggtaaccctaccggggttacccacccggttccctacccgtaccgaccgtacccctaacccgacccggtaaccgggtcccccctaacggtccccgggttacccctttccccccggtggtccccctaaaccccccg

SEQ ID NO: 106573 - DNA, 717 bp, Homo sapiens
  misc_feature: GYAE6OF01EXHVB.13.71.G05.1.454.CMB.1.raw
  modified_base (369)..(369): a, c, t, g, unknown or other
  misc_feature (369)..(369): n is a, c, g, or t
tcagtcacgtactacacgaccggtgctcgatttagtgtcgtcgcaagagagagggggggggtcaaccgccatccttgccctcctcctggctgttctccaaggagtctgtgccgaggtgcagctggtgcagtctggagcagaggtgaaaaagcccggggagtctctgaagatctcctgtaagggtttggaaacagtctttatcagccactggatcggctgggtgcgccagagtcggacccgggaaaggccgtgggagtgggagtggggatcatctatcctggtgactctgataccagatacacgcccgtccttccgaacggccaggtcaccatctcacgccgaacaacgtccatcacgacaccgcctacngacagtggacgcagcctaggaacggcccgtacggaccacccgacacttagttaacttactagtacgaactaaaacgtaccgactaacttaaccgttaacggttaacttaccgtaacccggttacctttaaccttaaccgtaaccgttaaacggttaacggttcgggtaaccggttaccggttacgggggaacccgtaaacggggtacccgaaccgggttcccgtaacccggtcccttaccccgtaccgaccgtcccccgttacccgaaccccgggaaaccgggtacccccgtacgttccccgggtttacccctttcccccccggtcgggtaccccttaacccccccgg

SEQ ID NO: 106574 - DNA, 757 bp, Homo sapiens
  misc_feature: GYAE6OF01CLF2N.13.71.G05.1.454.CMB.1.raw
  modified_base (202)..(202): a, c, t, g, unknown or other
  misc_feature (202)..(202): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (386)..(386): a, c, t, g, unknown or other
  misc_feature (386)..(386): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtagaaaaagcccggggatctctgaagatctcctggttaagggtttggaaacagtctttancagccatggatcggcgtgggtgcgccaagatcggacccgggaaagcctagggagtggagtggggactcatctatcctggngtaactntagataccagatacgacgtcccgtccttaccaaggccaacggtccacctatcacgacgaccgaatacgtccaatcgaacgccaccgtccttaaccgngaccaaggtcggagctaagccgtaggaacgcctacggacgacccgcctaagttacgtaacttacgtagtacgaactaaaacgtacgtacctaacgttaaccgttaacggttaaacgttaccgaaacccgggttacctttaaaccgtaacctaaaccgtaacggtacgtaacgggtaccggttacggttacggggaacccgtaaacggggtaacccgaaccgggttacccgtacccgttacccgtacccgttacccgtaacccgaccccgttaaacccccgaaacccgggtaaaccgggtacccccgttaaccggttaccccgggttaccccctttacccccccggtacgggtacccccttaaaccccccgg

SEQ ID NO: 106575 - DNA, 694 bp, Homo sapiens
  misc_feature: GYAE6OF01A6WSR.13.71.G05.1.454.CMB.1.raw
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
  modified_base (560)..(560): a, c, t, g, unknown or other
  misc_feature (560)..(560): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaacttgggttttccttgttgcttattttagaaggtgtccagtgtgaggtgcaacgtggtggagtcgtgggggaggtcttggtccagccgtggggggtccctgacgactctcctgtcaagcctcgtgggttcagtcttcgagttgtatagttggatgagcgtcgggtcccgcgagaccgtaccggaggggagggcgtgggaggtgggtacgaccaaanagtaaacacgaggaacggaagtcgaccatacgtancggcgactcgtagacggaacgggtccgtattccgactactccaccgaagacgaaccaaccgaccaaagtaacctactaagttattacgttacgaactaaagtccggacccgagtaggaacggtaacgacgggaacggtacctacgggtacttagttacgttaacgtttaccggngtacggacggtaagtaaacgtagttagggaacgttaggggtcggtaacccgttacggggtacggggggtttccccggggggaaccccggggtttaacccttggggaacccctaaacccgggtccgtaaacccgg

SEQ ID NO: 106576 - DNA, 734 bp, Homo sapiens
  misc_feature: GYAE6OF01BI587.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgctattttagaaggtgtccagtgtgaggtgcagctgacggagtcgtggaggagacttggtccgaggcccgggggggtccctggagactctcctgcatagtctacaagtatttatgttcaagttaattattggatgagctgggtccgcaggctccgaggggaagggctgggaggtgggtcggaccaacaagtaaacggcaacggagtaggaagtagaagaaacagtaagtggtaggtagttcgtaggtacgggaacggggtacccgtaatttacccgaacctacgttacccgtacccgaagggtaaaccgaaccgaaaccccggacccgaaaaacggtaaaccttaccgtaaaccgttaggtttaactccggtacgaccgaaaggtacttaggaacgtcccaacgggtcccgtagggaacggacggggaccggaacgggaaccgacgggtcttaggttaaacttacgttaccggtggtacggaccgggttaaaggggttaaacttttacgttttttacccgagttaacggttatttaacggggttaaggtttccggtttaaaccccgttacccgttaacccgg

SEQ ID NO: 106577 - DNA, 601 bp, Homo sapiens
  misc_feature: GYAE6OF01AWFIU.13.71.G05.1.454.CMB.1.raw
  modified_base (538)..(538): a, c, t, g, unknown or other
  misc_feature (538)..(538): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagccgtggggggtccctgagactctcctgtcaagcctctgggttcagcttcagtgtatattggatgagctgggtccgccagctccgaggggaagggcgtggagtgggtggaccaacaactaaacacgagaacggaagtacgaccatactagtgcgactctgtggaaggccgtattcaccatacctcgagacgaccaacgaccaaaggtaccctacacttaattacttgacgtaaacgtcggaccgtccgtaggacacggtacgaacgggaccaacgggtcttaagtcgttaacttacgtgtacgacgagtacgaagtggaacggnggtggcttaacgaggggttaccggggggaccccgggtaacctgggtcccaaccgtctaaaccg

SEQ ID NO: 106578 - DNA, 625 bp, Homo sapiens
  misc_feature: GYAE6OF01DZ8BF.13.71.G05.1.454.CMB.1.raw
  modified_base (221)..(221): a, c, t, g, unknown or other
  misc_feature (221)..(221): n is a, c, g, or t
  modified_base (296)..(296): a, c, t, g, unknown or other
  misc_feature (296)..(296): n is a, c, g, or t
tcagtcacgtactacacgaccggtgctcgatttagtgtcgtcgcaagagagaggagccttagccctggactccagggcctttccacttggtgatcagcactgagcacagaggactcaccatggaattggggctgagcttgggttttccttgttgcttattttagaaggtgtccagtgtgaggtgcagcgtgggtggagtcggtggggggggcttgggtccngccgtgggggtccctgacgactctcctgtgcagcctcgtggtcaccgtcagtcacacctacatgagctgggtccnccaggctccgagggagggctgggagtcgcgttcttcttttattagtagtagttgggtatactatacctccgacagtacctccgggtgggaacggggtcccgtattccgaccctaattccgtaccgtaagacgaactaacgttcccaaagactacggtcttcgtttacttacaaatcgaactagcctagagacgtccgatcggacgaccggtcttaggttacttactggtagtcggaagacgtaggtccgggaccctaacggtaaccgttactacggtctaaggtcggaccgttcgggaacggggccgaaacgggtccgaccggtacccg

SEQ ID NO: 106579 - DNA, 699 bp, Homo sapiens
  misc_feature: GYAE6OF01CHPOL.13.71.G05.1.454.CMB.1.raw
tcagtcacgtactacacgaccggtgctcgatttagtgtcgtcgcaagagagaggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctgggaggaggcttgatccgacggccccggggggtcctgagtactctcctgtcgcacgcctcgtgggttcaccgtcgagtcacacctacatgagtcgtcgggtccgccgaggcctccgaggggaagggcgtggagtgcgttctcttttattagtagtagtggtatacactacgtcgacagacgtccgtgggacgggccctattccacctactcctaccgaaggtacgaacctaaacttacccgaaaacggtaaaccaccgtaccgtttacgttttaccctaacgtaaaaagttcgaaaccgtacgtaccctagggaacgtacggccctaagttacgaaccgtaccgggtccgttagtttaaccgttaccggtaggttccggaaccgggtaggtaaccggacggttcccggggggaacccctaaacgggttaaacccgttaccgtaaccgtacgttacgggacggtaccggttcggacgggggacccgtaaacccgggg

SEQ ID NO: 106580 - DNA, 667 bp, Homo sapiens
  misc_feature: GYAE6OF01DJTE9.13.71.G05.1.454.CMB.1.raw
  modified_base (307)..(307): a, c, t, g, unknown or other
  misc_feature (307)..(307): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaacttgggttttccttgttgcttattttagaaggtgcccagtgtgaggtgcagcgtgggtggagtctgggaggaggcttgatccgagccggtggggggtccctgagactctcctgtcgcacgcctcgtcgggttcaccggtcagtccacctacctacatgagcgtcgggtccnccgaggctccgaggggagggctggngtgctcttntttattatagtgtggtatacatactcgcagactcgtggacgggctattcacatctacagataactaattaccaagtaaccacgtcttagttttcctataaaagttcgaacacgtccgtagacgacggacccgtattaaccggaccgtaccgggtaccgtttagttaaccttacgtggtacggaccggaaggtaacggtacgggtacccgggggtaaccccctaaacgggttaaaccccgtttaaccggttaacccgtaacggttacggttaacggggacccggtttaacccggggtcggggggtacccccgtaaaaaccggggggg

SEQ ID NO: 106581 - DNA, 800 bp, Homo sapiens
  misc_feature: GYAE6OF01DAABL.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagagactcaccatggcagttggggctgaacgttgggttttccttgttgtcttattttagaaggtgtcagtgtgaggtgcaacgtggtggagtcgtgggggagtcgttggtccgaggtccggttcggggggtccctggacgtaccttcctccgtgtaccaacgtcccttcggtcgggttcacgtcttacgaggttgttagtgttggattggacggtcggtaccgggtcccgaccgaacgtacccgtaccgggaaggggtaacggggtccgttaggggacgggttcgggggtacgaacccaaaagtaaacgtaaaaccgaacggaacggaacgggtaacgtaccgaccctaagttacgtacgtcgggaccgtactgtagggtacggaaacgggtccctattaccgaccttaatcccgtaaccgaggaaccgaacgtaacccgaacctaaaacgacccttacaactttaagtttacttagaaccgtaaaggtccgggaccctacggtaaggaacggtaaccgaccggggaacgaacccggtagggttaaccttaagggttacgtttaacgttacggttcggacggtaacggagtaaaggtacgttaggaaacggtgggttaaccggtacggttaccggggaggggttccccgggggtaaaccggtacccgtgggtaccctaccgtaccgtaacccg

SEQ ID NO: 106582 - DNA, 712 bp, Homo sapiens
  misc_feature: GYAE6OF01AOWC5.13.71.G05.1.454.CMB.1.raw
  modified_base (308)..(308): a, c, t, g, unknown or other
  misc_feature (308)..(308): n is a, c, g, or t
  modified_base (603)..(603): a, c, t, g, unknown or other
  misc_feature (603)..(603): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattgggctgagcttgggttttccttgttgcttattttagaaggtcgcccagtgtgaggtgcagcgtgggtggagtcgtgggaggaggtcttgatccgacggtccggttcggggggtccctggacgtaccttctccgtgtcgcgacgtccttcgtcggttccaccgtcacgtaccaccacctacntgacgcgtcggccgaccgacggccgtaccggaggggacgggtcgtgggtagtcgtcgttcctttattttatttagtagttagtgttacgtacactaccgtcgactacgtcgtccggtaggacggtacgtactaccacctcgtcctacgagaacgaactaacgtaaccgaacgtaaccctcgttactttacgtttaccaagttaacgacgtaaccgtacgaccgtacggacgaccgaacgtacgtacccggacgttccggggtaacccgtttagttaccttaggtcggtaggacgnggtaaacgggtacgggacccgggtaacccgtaaaggtaccgttacgtaccggtgttaacgggtcggtacccggttacgggtaacccgggaccggaaaccggggtacccg

SEQ ID NO: 106583 - DNA, 525 bp, Homo sapiens
  misc_feature: GYAE6OF01B8RB4.13.71.G05.1.454.CMB.1.raw
  modified_base (355)..(355): a, c, t, g, unknown or other
  misc_feature (355)..(355): n is a, c, g, or t
  modified_base (434)..(434): a, c, t, g, unknown or other
  misc_feature (434)..(434): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgctattttagaaggtgtccagtgtgaggtgcagctgacggagtctggaggagacttggtccaggccgggggggtccctgagactctcctgcatagtctcaagatttatgttcagtaattattggatgagctgggtccaccaggctccgaggggaaggggctggagtgggtggccaacataaagcacgatggaagtgagaaacngtatggtaggagtctggtggaacgggccgattcgacctatctccagacgacaacgccaagaactcactgtatctgcagntgagcagctaggagaggcgaggacacggctagtatattactgtgcgaagggtattntttacngtgtattaggtagtcggttactccgtacg

SEQ ID NO: 106584 - DNA, 646 bp, Homo sapiens
  misc_feature: GYAE6OF01EDG7T.13.71.G05.1.454.CMB.1.raw
  modified_base (602)..(602): a, c, t, g, unknown or other
  misc_feature (602)..(602): n is a, c, g, or t
tcagtcacgtactacacgaccggtgctcgatttagtgtcgtcgcaagagagaggagccttagccctggactccaaggccttttccacttggtgatcagcactgagtacagaggactcaccatggaattggggctgagctgggtttttccttgttgcttattttagaaggtgtccagtgtgaggtgcagctgacggagtctgggaggagacgttggtcccgagggcccggggggggtccctggacgactctcctgcatagtctacaagtatttatgttacagttaattagttggatgagtcgtgggtccgccgaggcctaccgagggggaacggggtcgtggggaggtggggtcggaccaaacaagtaaacgcaacgagtagggaagtagaacgaaacgagtagtggtggagttcgtagtaggaagggccgtattcaacctatccaccgaagacgaacaaccgaccaaagacctacactagtactcgtgacgagatgagcgacgccgtagggaaggacggggacggaacggaaccgacgggtacttagttaattacgttacgtggtacggacgggtaaaggggttaattttacgttttaccgngttagtaacgtttaggttaaggtttcgtttaacctcccgtaacg

SEQ ID NO: 106585 - DNA, 645 bp, Homo sapiens
  misc_feature: GYAE6OF01BX8IG.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgcttattttagaaggtgtccagtgtgaggtgcagctgggtggagtcgtgggggggcttggtccagccgtggggggtccctgagactctcctgtgcagcctcgtggattctacttttagtaggttattggagttggggttggtccgccagctccagagaagggctggaggtgggtgccaacataaagggaagagtggaagtagaaagatactatggtggactctgtaggaaggggccgtattccaacctatcctaccaaggacgaaccaaccgaccaaagaacctcaacttgtaatcgtgacagatcgacccagtcccgtagacgtacggtacgaagggtacgttaccggggcttaggttacgttaagttttacgttggtacgggacgtagggaaggtcggtagggggacccaacgggtactttaaggtttttaggaacggtaggggtttcggttaaagggttccgggggacccggtacgggggtaaccccggg

SEQ ID NO: 106586 - DNA, 603 bp, Homo sapiens
  misc_feature: GYAE6OF01A6YRT.13.71.G05.1.454.CMB.1.raw
  modified_base (421)..(421): a, c, t, g, unknown or other
  misc_feature (421)..(421): n is a, c, g, or t
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
  modified_base (531)..(531): a, c, t, g, unknown or other
  misc_feature (531)..(531): n is a, c, g, or t
  modified_base (554)..(554): a, c, t, g, unknown or other
  misc_feature (554)..(554): n is a, c, g, or t
  modified_base (564)..(564): a, c, t, g, unknown or other
  misc_feature (564)..(564): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagcttgggttttccttgttgctattttagaaggtgtccagtgtgaggtgcagctgggtggaggtcggtgggggggggtcttgggtccgaggccggttcgggggggtcccctggacgaccttccgtcctggtcgccagcccttcgtggtattctaactttttaggtaggttattggagttggggttgggtccgcagacctccaggaggaagggacgtgggaggtggggtcggaccaaacgaagtaaaaggaagatagggaaagtagaaagatacgtagtgtggaactntggtaggaaagggccgtattaccactactcctaccagaacgaaccgaaccgaccaaagaacctacactgtatcngacagatcgaccngctgagagtcgaaggactacggngtgtgttattgtgtcgagagagnggtgggcagnttagtttgaggtggtgtaggtcgggcggcgggtacccgg

SEQ ID NO: 106587 - DNA, 728 bp, Homo sapiens
  misc_feature: GYAE6OF01DB9TF.13.71.G05.1.454.CMB.1.raw
  modified_base (431)..(431): a, c, t, g, unknown or other
  misc_feature (431)..(431): n is a, c, g, or t
tcagtcacgtactacacgaccggtgctcgatttagtgtcgtcgcaagagagaggagccttagccctggactccaaggcctttccacttggtgatcagcactgagcacagagactcaccatggaattggggctgagctgggttttccttgttgcttatttagaggtgtccagtgtgaggtgcagctgggtggagtcggtggggggggcttgggtccaggtccggtgggggggtcccctggacggtacctcctccgtgtgcacgcctcgtggtattctaacttttttaggtaagggttagtttgggtagttcggggggtttcgggtcccgccgaaggtacctcccgaaggaagggaaagggggtactggggaagggttgggggtacggacccaaacgtaagtaaaagggaagtagtagggaagtagaaaagtntaactagtggtgacttgtggaggaacgggcctattccaccatcctaccgagacgaacaaccgaccgaaagactcaactgtatccgtgacagactacgaccaggtccctaggaacggtacggtacggaagggtacgttaaccgggtcgttaggttagtttaagtttacgttagggtacggaacggaggtaagggtagggtcgggggtaacctaaacggttacgttaaggtttttagggaagggttacgggtttacggtacggggtacgggggcccggtaacggggggtaacccccggg

SEQ ID NO: 106588 - DNA, 624 bp, Homo sapiens
  misc_feature: GYAE6OF01APS9Z.13.71.G05.1.454.CMB.1.raw
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatggcccgggaaagccgtggagtggagtggggatcgatctatcctggtgactctgataccagactacacgccccgtccttaccgaaggcccaggtcaccgatcctcacgccgacaacgtccactacacgaccaccgccctactcgcaggtggacgcagcccgtagaacggtcccgtacggaccacccgccagttcgtactttactcggtagacctaaaatccgactaacgtaactacggtaacttccgaccggtctttaactacctaacgtaacggtatacgggtacgtacgtgggacctaacgggcccaacggtccaccgtctcccgtcaccgccctacccaaccgtacggacccctcgttccccgttacccttcccccgtgtccccgtaccccg

SEQ ID NO: 106589 - DNA, 677 bp, Homo sapiens
  misc_feature: GYAE6OF01BT1UU.13.71.G05.1.454.CMB.1.raw
  modified_base (463)..(463): a, c, t, g, unknown or other
  misc_feature (463)..(463): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggggcttggtccagccgtgggggtccctgagactctcctgtcgcacgccttcgtggtacttcctaacgtttttaggtaggttagttgggtagttggggttcgggtcccgccaaggtacctccgaaggaaggaagggtacgtgggaggtgggtcgaccaaagaagtaaaggaagagtaggaagtagaaagtataacgtagtggtagactcgtgtaggaagggcctattcactatctacgagacgaacaacgaccaagtacnctacgtgtactctgacgaagtactacgaacctagtcccgtaggacgtaacgggtcggaagggtacgtaaccgggtcgttaggttagtttaagtttacgttggaggtacggaggttagggagggttcgggaccgtaacggtacgtttagttttagggaagggttacgggttaggttaaccggggtcggggtaacccggtaagggggtacccccgg

SEQ ID NO: 106590 - DNA, 713 bp, Homo sapiens
  misc_feature: GYAE6OF01DVXHG.13.71.G05.1.454.CMB.1.raw
  modified_base (307)..(307): a, c, t, g, unknown or other
  misc_feature (307)..(307): n is a, c, g, or t
  modified_base (417)..(417): a, c, t, g, unknown or other
  misc_feature (417)..(417): n is a, c, g, or t
tcagtcacgtactacacgaccggtgctcgatttagtgtcgtcgcaagagagaggggagaggagcccagcactgggattccgaggtgtttccattcggtgatcagcactgaacacagaggactcaccatggagttttggctgagcttgggttttccttgttgcttaattttaaaaggtgccagtgtgaggtgcagcgtggtggagtcgtgggaggaggcttgatccgaggtccggtcggggggtccctggacgtacctctccgtgtgcacgccttcgtcgggttaccaccgtcacgtccaacacctanatgacgtcggtcgggcccgccgaggccgtaccggaggggacgggtcgtagggacgtcgtcgttctttacttttaagttagtaggttagtggtaagtactagtacctccgnacgtccgtcggtgggacgggcttattaccacctactcccgtaccaggaacgtaacctaaacgtaccaaagtaaccctcgtaccgttttcgttttacctaacctaaagtccgaaaccgtacgtaccgaggtaacggaccgtaccgtaggtaccgacccgggtaccggtacgtttattacgttggtacggcggaacggtaaggtacgggtaccggttaacccgggggaccccttaaagggttaacccgttacacggtacgtaggttaccgggtacgtccgggtaccggggaaacccgg

SEQ ID NO: 106591 - DNA, 730 bp, Homo sapiens
  misc_feature: GYAE6OF01DB9BT.13.71.G05.1.454.CMB.1.raw
  modified_base (131)..(131): a, c, t, g, unknown or other
  misc_feature (131)..(131): n is a, c, g, or t
tcagtcacgtactacacgaccggtgctcgatttagtgtcgtcgcaagagagaggagccttagccctggactccaaggcctttccaattggtgatcagcactgagcacagagactcaccatggatgggctgngctgggtttccttgttgcttatttagaaggtgtccagtgtgaggtgcagctgggtggaggtcggtgggggggcttggtccaggtccgtcggggggtccctgacgtactccttccgtgtcgcacgtcctcgtcggtattcttaacgtttttaggtaaggtttgttggtacgtgggggtttcggtccggccaagtcctaccgagaaggaaggggtacgtgggaggttggggtcggacctaaacgaagttaaaaggaaaggtagtacgggaaagtaggtaaaaggattaactagttggtacggtaactcgtggtaacgggaacggggtcctaacgtttccgaacctacgtccgtaccgaagacgaaaccgaacccgacctaaagtaacttaccaccgttagttacgtcctagcgaagtacgtaacgacccgtaacgtccgtaaggtagaccggtaggaacggtacgtaacggtcgttagttagttagtttacggttgtacgtacggagggtaggcggtagggacctaacggtacgtttacgttttaggacgggttaggttacggggttacggtaccggggacggttacggggtaaccccggg

SEQ ID NO: 106592 - DNA, 815 bp, Homo sapiens
  misc_feature: GYAE6OF01EYDKB.13.71.G05.1.454.CMB.1.raw
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtagaaaaagcccgggagtctctgaagatctcctgttaagggtttgaaacagtctttatcagccactggagtcggcgtgggtgcgccagatcggacccgggaaaggccgtgggaggtggagtggggactcgacttctagttccgtggtcgactcgtagactacgagtactacgacgtccccgtctaccgaaggtcccgaggtaccacctactcctcgacgcccgaacgtaacgtccaactccacgacccacccgtacctaccgtcgacgtaggtcggacgtaccgacgtacccgtaggaaaccggtccccgtaccgggaacccaccccggtaccctaagttacgtttaacgtttaacgttacggttaacgaaacctaaaaacgtacccgaaccttaaacctttaacccggttaaaccgtttaaaccgttacccgtaacccggttaacccctttaaaccgtaaccgttaaaccgtaaacccgggttaggttaaccgggtaaccggttaccgggttaccggggaacccggaaaccgggtaccccggtaacgggtccccgtaaccccgtcccgttacccgtccgaacccgtccccgtacccgaaaccccgaccgggaaccccttaccggttaccccgttaccccgttacccccccgtcggcccccgttaaccccccg

SEQ ID NO: 106593 - DNA, 742 bp, Homo sapiens
  misc_feature: GYAE6OF01CNDPD.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaattggggctgagcgttgggttttccttgttgcttattttagaggttgtccagtgtgaggtgcagctggacggagtcgtgggaggagtacgttcgggtcccgaggggtcccgggggggtcctggacgaccttcctccgtgctatacgtcactaagtatttatgttactaagtttattagttaggataggtagtcggttcgggtcccgaccgtaggggtcctaccggggaagggggtaaggggtccgtaggggtagggtcggggtacgaccgaaaactagtaaacggccgaaggaggtagggaagtagaaacgaaacgtaggttagtaggtggtaacgttcgttaggaaggggtaaccgggtaccgttaattccgaaccttacttacccgacgaacgaagaaccgtaaacccggaacccaaaacgtaacctacgtaaccgttagttaccgttacgacgacgtaaggtacgtagaacacggacgacgtagggagacggggagacggaccgaggtactagttaacttacgtaggtagggtaccgtaagggtaacgggttaaatttcgttttaaccgagttaggtaagtttaggtacgtttacggttaaccttaccgttaccg

SEQ ID NO: 106594 - DNA, 808 bp, Homo sapiens
  misc_feature: GYAE6OF01CFE9H.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagagactcaccatggaattggggctgagctgggttttccttgttgctattttagaaggtgtccagtgtgaggtgcagctggtggaggtcggtggggggggcttggtccagccgtggggggtccctgacgtactctcctgtgcacgcctcgtggtattctaacgttttaggtaggttagttggtagttggggtttcgggtcccgccgagtacctaccgaaggaggaacgggtcgtgggaggtcgggtcggaccaaacgaagtaaaagggaagagtagggaagtagaaaagtatactagtgtaggtactcgtaggtaggaacgggtaccgtaacttaccgacctacgtcctaccgaagacgtaaccgaaccgaacccaaacggtaacctctaacttacggttaactaccgttagaccgtaagtaacgttcggaaccccgaaggtcccgtaaggtaaccggtaaggtccgggtaaaggggtaacgtacccggggtactttagggttacgttttaagtttacggtttacgggtagacccgggtaaagggtaacgggttaacgggttaccgggggggtaaacccctaacggggtaaccgtttttaagggtttttaaacgggtaaaccggggttaggggtttaacggggttaacccggggaccgggggggttaacccgggtaaacccggggggttaaccccccgggg

SEQ ID NO: 106595 - DNA, 693 bp, Homo sapiens
  misc_feature: GYAE6OF01AQJWY.13.71.G05.1.454.CMB.1.raw
  modified_base (204)..(204): a, c, t, g, unknown or other
  misc_feature (204)..(204): n is a, c, g, or t
  modified_base (404)..(404): a, c, t, g, unknown or other
  misc_feature (404)..(404): n is a, c, g, or t
  modified_base (677)..(677): a, c, t, g, unknown or other
  misc_feature (677)..(677): n is a, c, g, or t
tcagtcacgtactacacgaccggtgctcgatttagtgtcgtcgcaagagagagggggggggtgcctcagccatggcatggatccctctcttcctcggcgtccttgcttactgcacaggatccgtggcctcctatgagctgactcacgccaccctcagtcgtccgtcgtccccaggacagacagccagcatcacctgctctgganagtaaagtggggaataaatgtgcttgctggtatcgagacgagacgcgacggcctacgttcccctggtcggtcgttcggtactactcgttataacaacgtaaccgtaccgaacggcccggtaccccgtacggacgggtactacccgtaggactacgttacttcgtcgtcgtacccttaccgtaaccgtcgaacggtaaccncggaaccaccctacgtaccgtaccacccgtagaccgtacgggacccggaccggtaggcgtggtaggacgtaggtacggtacgtacgtacttacgttacggtccgacggtcgggtcggtacgacgtacggccaccggtcgttccgtcccggtaccgttacccggtaacggtaaccggtacggactaccgtcccgtacgtacgtaccgaccgaaccgcccgtacgaaccccctacggaccttaccgaccgttacctaccgttccccgttaccccncccgttacgttacccg

SEQ ID NO: 106596 - DNA, 688 bp, Homo sapiens
  misc_feature: GYAE6OF01DZCEJ.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggaattggggctgagctgggtttccttgttgctattttagaaggtgtccagtgtgaggtgcagctggtggagtcggtggggggggcttgggtccaggccgtggggggtccctgagactctcctgtgcagcctctggattctacttttagtaggtattggagttggggttgggtccgcagactccaggagaagggctgggaggtggggtggaccaacaagtaaaagggaagagtagggaagtaggaaagtatactagtggtggtacttcgtaggtaggaaacggggtccgtattccgaacctataccgtaccgaagacgaaccaaccgacccaaaggtaacctcaacttagtaactcgtagcaagtactacgacccacgtccgtaggagacgtacggaaggacgttaccgggacttgggttagttaacgtttagttcggttacggacggtagtaagggtacggttacgggggacctaacgggttaactttaacggtttttggaaaacgggttcggggtttaacgggtacggttacgggggggtacccggtaggggggtaacccccggg

SEQ ID NO: 106597 - DNA, 792 bp, Homo sapiens
  misc_feature: GYAE6OF01AYEUP.13.71.G05.1.454.CMB.1.raw
  modified_base (476)..(476): a, c, t, g, unknown or other
  misc_feature (476)..(476): n is a, c, g, or t
  modified_base (505)..(505): a, c, t, g, unknown or other
  misc_feature (505)..(505): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtagaaaagcccggggagtctctgaagatctcctggtaagggttttggaaacagtctttatcacgccacgtggagtcggtcgtggggtgcgccgagagtcgggacccgggaaaggtccgtgggaggtggagtggggatcagtctacttccgtggtgacgtctgactaccgagtataccgacgtcccccgttccttaccgaacggcccgtacggtacccacctacgtacctccgacgacccgaaccaacggtcccaagtaccgaccgcccacccgtccctaccgtgacctacggtggacgccgacgccgtacggaacccggtccgtaccgaacccncccggtactaagtttggtaacctttacgnggttaaacgaacaaaacgttacccgaacttaaccgttaaccggtttaaaccggtttaaccttaccccgggtaaacccggtttaccctttaaaccggttaaccttaaaccggtaaaccgggttcgtaccggggtaccggttccgggacggggaacccgaccggggtaccctaccggttacccgacccgttcccggaccttcccgaccgtaccccttaccggacccggaacccgggtccccctggttacccccggtcccccttaccccggtccggtccccctacccccg

SEQ ID NO: 106598 - DNA, 820 bp, Homo sapiens
  misc_feature: GYAE6OF01A3Z4W.13.71.G05.1.454.CMB.1.raw
  modified_base (779)..(779): a, c, t, g, unknown or other
  misc_feature (779)..(779): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgcttattttagaggtgtccagtgtgaggtgcagctggacggagtctgggaggagtacttggtccgagggcccggggggtccctggacgacttctcctgcctatagtctacaagtattttagtgttacaagttaatttagttaggattgagtcgttcggggtcccgccgagggtccgtaccggaagggggtaacggggcgtaggggacgggttcggggtacggaccctaaacgtaagtaaacggccgaacggtaagtagggaagtaggaaagaaacgtaggttaagtaggtagggtacgttcgttaggtacggggaaacggggtcccgttaaacgtttacccgaaccgttaacgttacccgtaacccggaaagggtaacccgaaaccccgtaaaacccgggaacccctaaaaacgggtaaacccgtttcctaaaaccggtttcgtttaaccgtttaccggtaacggaaccgtaagggttaatacggggaaccgtcccgtaacgggcccgttaaggggaacgggacggggtaccgggaaccgggacccgtaacgggtccgtttaaggtaactttaacggttaaccggtgggtaaccgggagggttaaacggttaagttttctttacggngttagtacggttaggttaccgtttacgttacctcccgtacg

SEQ ID NO: 106599 - DNA, 828 bp, Homo sapiens
  misc_feature: GYAE6OF01A5AD8.13.71.G05.1.454.CMB.1.raw
  modified_base (745)..(745): a, c, t, g, unknown or other
  misc_feature (745)..(745): n is a, c, g, or t
  modified_base (751)..(751): a, c, t, g, unknown or other
  misc_feature (751)..(751): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcagttgggctgaactgggttttccttgttgcttattttggaaggtgtccagtgtgaggtgcaagtggtggagtcgtgggggagtcttggtccagccggtgggggtccctaggacgtacttcctccgtgtacgaacgtcccgttcgtcgggttcacggtcttcgtaggtacgttaattagttggtaatggtacgtcggttcgggtccccgaccgtaacggtaccggtaccccgggaagggggtaaccggggtcgttacgggggacggtttcggggtaccggaacccgtaaaacgtaaaccgtaaaacgaaccggaaaggtaaaccgggtaacgttccggaaaccccgtaagtttaccggtaacggtacggacccggtaaccgtttcccgttaggggaacggtaaccggggtcccgttaaaggtttacccaaccgtaacgtttacccgaacccgtaaggaaacggtaaacccgtaaccgtaaccgtaaaacggtaaccctaaccttaacgtttaaacttaacggttacaaacggtaacgtcccgggtaaaccgtcggtaaccggaaggtaaccgacggaaacgtaccgtacggtaccttaagtacgttacctacggtgtaccgnggtaanacgtagtaggagtcggttagaccgtagggttacgggtccgggtaacccggtctacggaccctaccggtataccccgg

SEQ ID NO: 106600 - DNA, 935 bp, Homo sapiens
  misc_feature: GYAE6OF01AO132.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggcagttggggctgaacttgggttttccttgttgtctattttagaaggtgtccagtgtgaggtgcaacgtggtggaggtcgtgggggaggtcgttcggtccgacggccggttcggggggtcccgtggacgaccttcctccgtcgtaccgaacgtcccgtcggttcgggttcgacgtcttacgtagttgttattagttggatggacgtcggtcgggtccgaccgacgaccgtccggtaacgggggacggggtcggtagggtagggtcggggtaccggacccgtaaacgaaacgtaaacgaaccgtaacgggaaaccgggaagtaccgaaccgtaacgttaacgtacgttacgggaccggtaaccgtttcgtacgggtacgggtaaccgggtaccgtacgttacccaaccgtaccgttacccgtacccggaaaggtaaccccggaaacccgtaaacccggaaacccgtaaaaccggttaaaccctacccgttaaactttaaacggttttaacgtttacccggaaaacgtttaaaccgggttaccccggaaacccggttacccggttaaaggggaacggaacccggaaacggggtaacccgggtaaacgacccggggtttaacttaagttaaccggtttaaacttacgggttcggtaaccggaggtaaaccgggtagttaaagggttacgggaaggttacggggttaacccggtcgttaaaacccggggggttcgggggttaacccgggggggtaccccccgggttaaacggttacccgggggtacccccttaaacgggttacccggtaaaacccgg

SEQ ID NO: 106601 - DNA, 748 bp, Homo sapiens
  misc_feature: GYAE6OF01ELNN2.13.71.G05.1.454.CMB.1.raw
  modified_base (196)..(196): a, c, t, g, unknown or other
  misc_feature (196)..(196): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctagaagatctcctaggttaagggttttgaaacngtctttatcagccacgtggatcggcgtgggtgcgccgagagtcgggaccccgggaaaaggtccgtagggaggttagggacgttaggggggaacttccaagtttaccgttaagtccccggtttgggtacggtaaccttaccggtagtaaccggtaaccctaaggtaactaaccgaaccgttcccccgttccgtttacccgaaggcccgtaacggtccaaccgtatctaccacgacgaacgaacttcaatcacgaccaccgtactaacccgtgccgagtcggagccagtccgtagacgggcctcggaccaccgtcctagtagtacttatcgtacgaataaactacgactaactaactacggttaactaccgtacggtaccttaacctaactaacgtaacggttagacggtacgtccggtacgggtaccgaaccgggtaccgtcgtaccgtacccgtccctccgtaccgtacccgcccgttaccccgaaccggtaacccgacccgtaaccgttaccccggttcccgttccccccgtcgtaccccgtaaccccccg

SEQ ID NO: 106602 - DNA, 656 bp, Homo sapiens
  misc_feature: GYAE6OF01A451O.13.71.G05.1.454.CMB.1.raw
tcagtcacgtactacacgaccggtgctcgatttagtgtcgtcgcaagagagaggggagaggagcccagcactgggattccgaggtgtttccattcggtgatcagcactgaacacagaggactcaccatggtagtttttggctgagcttgggtttttccttgttgtcttaatttttaaaaggtgcccagtgtgaggtgcagcgtgggtggagtcgtgggagggaggtcttgactccgacggccggtcggggggtccctgagtacctcctcctgtcgcgacgtcctcgtcgggttccaccgtcacgtccacacctacagtgacgcgtcgggtcccgccgacggccgtaccggagggggaaggggtcgtgggaggtcgtccgttctttacgtttttatttagtaggttaggttaggttacgtactataccgtccgacgtacgtcgtccggtggacgggccgtactccactactcctccgaagacaactacttacccaaacgaacacgtcgtttctttactaacaaactacgaactcgacgtagacgacgccgatcgacgtcggtactagttcttacgtggcggacgtaggagtaccggtcgggaccctaacggttaacgttacgaccgtgtacggtcgggtacgtcggtacgggaccgg

SEQ ID NO: 106603 - DNA, 998 bp, Homo sapiens
  misc_feature: GYAE6OF01DD0NC.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgctattttagaaggtgtccagtgtgaggtgcagcgtgggtggagtcgtgggagggaggtcttggactccgaggccggtcggggggtccctggacgtacctctcctggtcgccagtcccgttcgtacggggttaccacccgtctacggtaccaaccaacccttaacagttcggaacggtcgttccgggggtaccccgaccggacggaccgtccgggaaagggggtaacgggggtccgtaggggtacggttcggtccggtttactttttacgttttttaagtttaacggttaaacgggtttacggtttagggttaaacgttacccgtaaacgttaccccggttacccgtacgtaacccgggtacccgttacccggggttaggggaacccggggggtacccgttaaagtttccccggaaaaccctaccgtttaccccggttaaccgaaacggtaaacccggtaaacccgtttaaaccgtttaaacccccgaaaaacgggtaaaccccgttaccggtttaacccgtttttaacggttttttaacccctttaaacgggtaaaaaccgttttaaccgaaaacccggtaccggtaccccgtttaaagggaaccgggtaacccggtaacccgtaaagggttacccggaaacccggttaacccgggggttaccggtttaacgtttaaacgtttaccggtttagggaccggttaaaccgggtaagggaacgggttaccgggttaacccgggggaaccccttaaaccgggttaaacggtttaaccgtaccggtaacgttacgggttacgggtaacggttcccggggtaacgggacccggtaaaccggggtaaccccg

SEQ ID NO: 106604 - DNA, 709 bp, Homo sapiens
  misc_feature: GYAE6OF01BQUIO.13.71.G05.1.454.CMB.1.raw
  modified_base (555)..(555): a, c, t, g, unknown or other
  misc_feature (555)..(555): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggagcttggtccagccgtgggggtccctgagactctcctgtcagcctcgtgggtcagtcttcagtgttatagttggatgagtcgtagggtcccgacgacgaaccgtaccggaagggggaacggggtccgttaggggagggttcggggtacggaaccctaaaacgaacgttaaaaccgacgtaacggaaaccggtaaacggtacgaacccctaagttaaccgttaagtcggaccggtacttcgtaggtacggtaacggggcctagttacccgaaccctacttacctaccgaaggacgaacccaaccgccaaagtaacctaccaattattactttgaacctaaagtcgggaccctntaggaagacggaacgaacggactacgggtacttaggtacgttaatacgtagtacggacgtaagtagacgttggaaagtcgggtacggaacgttacggtacgggggttaccggggaaccccggtaccttggggtaccctacccggtactaacccg

SEQ ID NO: 106605 - DNA, 794 bp, Homo sapiens
  misc_feature: GYAE6OF01DID2M.13.71.G05.1.454.CMB.1.raw
tcagtcacgtactacacgaccggtgctcgatttagtgtcgtcgcaagagagagggggggggtgcctcagccatggcatggatccctctcttcctcggcgtccttgcttactgcacaggatccgtcggcctcctatgagctgactcacgcccaccctcgaggtcgtccgtccgtcccgaggacagacacgccagcactccaccgtgctcgtaggaagtaagttaaaggttgggggaaattaaagtagtgtcttgcgttagtatcagcgaacgtaacgccgagcccgtaccgtcccgtggtcgtcgtagtctatacgtatacgaacgtactaaccgaacggtcccggtaccgtacggacggactacccgtagtacgtacggttacttccgtcgtccggtacctaccgtaacgtacggtaaacggaaccctaccgaccgtaaccctacctacgtaccgaactaccgtacggaacgggtacccggaaccggtagggtctagggtcggtaaccggttaggaccggtactttacgtaacttaacgttacggtcgaggtacgggttcgggaagaccgtacggacaccggtctaaccggttcccgtaaccggttcccggtaacgggaccggtaaccgggtaacccgtacgggtttcccgtaaccccggttcgggtaacccggtaccgaccccgggaaaccgaaacccccggttaacccccaaccccgtttacgtaccgtaccccggtttacccctttacccggacccccctttaaccccgacccgtttcccgttaaaccggg

SEQ ID NO: 106606 - DNA, 737 bp, Homo sapiens
  misc_feature: GYAE6OF01A46TW.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcacatggaattggggctgagtcttggttttccttgttgtctttagtttagaaggttcgtccagtgtggaggtgcgagtcgtggtggtaggttcgggtgggggggtcttggtaccgacggtccggttcgggggttaccctggacgtccttcgtccgtggtccgcgtacgtccgttacgttagtacgtttaccttacggtttttaggtaggtttagttgggtaggtttcggggtttcggtacccggaccgtaagtacctccggaaggaacggttaaacgggggctaggggtaaggtcggggttcggaacctaaacgtaagtaaagggtaagtacggtagggtaaagtaggaaaacgtattaccgtaagtggtacgtacgtcgttaggtaacgggacgggtaccttacgttaccaccgtacgtccgtacgagaacgacgaacgacctaagactcgtatagtactcaggacagactaccgacgctccggagacgacgtaggacgtacggtaacgtcgttaagttcgttaacgttggtaggtcggagtacgggtgaaggttcggacttagacgtttagttaagtgggtacgttacgggacggtcggggaccggtcggtaaccccggg

SEQ ID NO: 106607 - DNA, 663 bp, Homo sapiens
  misc_feature: GYAE6OF01C7HOB.13.71.G05.1.454.CMB.1.raw
  modified_base (358)..(358): a, c, t, g, unknown or other
  misc_feature (358)..(358): n is a, c, g, or t
  modified_base (583)..(583): a, c, t, g, unknown or other
  misc_feature (583)..(583): n is a, c, g, or t
  modified_base (594)..(594): a, c, t, g, unknown or other
  misc_feature (594)..(594): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagcgttgggttttccttgttgcttattttagaaggtgtccagtgtgaggtgcagctggacggagtcgtgggaggagaccgttggtccgacgggtcccgggggggtccctggtaacggtaccttcgtcctgaccgtaatacggtctacgaaagttatttagttagttactaagttaattattaggatgagtcgtcggccgccgaggcctacggaggggacgggtngggaggtggggcgaccaaacaagtaaacgcgacggaagttaggaaggtagaaagtaaacgtaggttagtggtaggagttcgtaggtacgggtaacgggccgtagttacccaacgattccccagaacgtacggaaaccctacgaaaccaaacggtactaacctaccggttatacgtcgtacacgataccgtgacgcaggcagggtagagggcgaacggcgtaacgngttacgatttnacgttgacgtaggaagggttattactttaagtgtacgagtttaaggactttaccgtttaactcctacgg

SEQ ID NO: 106608 - DNA, 722 bp, Homo sapiens
  misc_feature: GYAE6OF01BE57D.13.71.G05.1.454.CMB.1.raw
  modified_base (632)..(632): a, c, t, g, unknown or other
  misc_feature (632)..(632): n is a, c, g, or t
  modified_base (672)..(672): a, c, t, g, unknown or other
  misc_feature (672)..(672): n is a, c, g, or t
tcagtcacgtactacacgaccggtgctcgatttagtgtcgtcgcaagagagaggagccttagccctggactccaaggccttttccacttggtgatcagcactgagtacagaggactcaccatggaattggggctgagcttgggttttccttgttgcttattttagaaggtgtccagtgtgaggtgcagctggacggagtcgtgggaggagacgttgggtccgacgggcccggggggggttccctggacgaccttcctccgtgccattacgtctacaagtattttatgtttactaagttaatttagttggatagacgtcgtcgggtcccgccgacggtccgtaccggaagggggacggggtcgtaggggaggtcggggtacggaccaaacgaacgtaaacggcgaacggtagtaggaaggtagaaacgaaacgtagtagtggtggtagtcgtaggtagggaacgggtccgtaacgttaccaccgtactaccgtaccgaagtaacgaccgaaaccgaccaaaagtaacctacgtacgtacgtatcgtagacaggtatacggacgcgacggtaccgtagggaaggacgggaccgaacgggacccgtaaggtcttaaggttacttacgtttaccgngggttacggacggttaaagggttacgtttacttttaccgngttaaggttaagtacggtttaaggttcccgttaaaccgttccgtaaaccg

SEQ ID NO: 106609 - DNA, 685 bp, Homo sapiens
  misc_feature: GYAE6OF01C567H.13.71.G05.1.454.CMB.1.raw
  modified_base (194)..(194): a, c, t, g, unknown or other
  misc_feature (194)..(194): n is a, c, g, or t
  modified_base (650)..(650): a, c, t, g, unknown or other
  misc_feature (650)..(650): n is a, c, g, or t
tcagtcacgtactacacgaccggtgctcgatttagtgtcgtcgcaagagagaggagccttagccctggactccaaggcctttccacttggtgatcagcactgagcacagagactcaccatggcagttggggctgtaacgttgggtttttccttgttgtacttaattttaaaaggtcgccagtgtgaggtgcagntggtggagtcgtgggaggaggtcttagactccgaggtccggtcgggggtccctgacgtactccgtcttgtgccgtacgccttcggtcggttcctaccggtcaacgtaccaaccacctacatggacgccggtcggtcccgaccgcggccgtacgggaggggacgggtcgaggtagtcgtacgttcttttatttagttagtaggtaggtacgttatactacgttaccgcgtactacggtacgtccgggagggtacccgggtcgtaactaccgtaaccgtactacctaggaacgaaacgtaacctaacgtaaacccgaagtaacccgttcgtcgttttaacgttacccttaaagaaacgtccgtaaacctgtacccgtaagaccgtaccgactagtaccggaaccgtcgtagttgttactacgtggaacgtaacgaagttcgaccgactacgtattacnggacttagcgtacgtcggacggactccgacgtccg

SEQ ID NO: 106610 - DNA, 718 bp, Homo sapiens
  misc_feature: GYAE6OF01EBDCN.13.71.G05.1.454.CMB.1.raw
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
tcagtcacgtactacacgaccggtgctcgatttagtgtcgtcgcaagagagaggagccttagccctggactccaaggtcctttccacttggtgatcagcactgagcacagagactcaccatgaattgggctgagctggtttcctagtgctatttagagtgtccagtgagagtcgcagtcgtggtggacgttcggtggggggtccttaggccgtaggtccccggtcggggggttacccctggaactcttccgtccgtgtcgacngtccctgtagtnttcttacgttttagnggttattggtgttcgggttacggtccacgtacgacctaccgaaggaaggaacggtacgtggaggttgggacgaccaagtaagtaaggacgtaggtggactgaactacgtattagttagtcgtagtacgtgtggtcgggacggtactactccacgttacttaccgaggtacaaccgtacgacccgtaggtaccttacggtataaggttactacgtaccgtaccgtaattaaaggccgggaagaaccgtttcccggaaggttaacgggaaacccgtttgaaacggttcgtaacccgttaaccgggtacctttaaaccggtatttaccgggtttaaatcggtaaccgtgtaaccgttagttacgtacctttacggttaccggagttaccccggattccccggtagttagggtcgtacgggttcggtaaccg

SEQ ID NO: 106611 - DNA, 876 bp, Homo sapiens
  misc_feature: GYAE6OF01EOMI2.13.71.G05.1.454.CMB.1.raw
  modified_base (763)..(763): a, c, t, g, unknown or other
  misc_feature (763)..(763): n is a, c, g, or t
  modified_base (855)..(855): a, c, t, g, unknown or other
  misc_feature (855)..(855): n is a, c, g, or t
tcagtcacgtactacacgaccggtgctcgatttagtgtcgtcgcaagagagaggggagaggagcccagcactgggattccgaggtgtttccagttcggtgatcagcactgaacacagaggactcaccatggtagttttggctgagtcgttgggtttttccttgttgtacttaagtttttaaaaggtcgtccctaggttggtaggtaggtgcgtaggtttgggtggagttcgtagggagggtaggtcgttcgggtcccggacggggtccccggggggggttccctagggtacgtaccttcctacgtagttcggtcggcccggtccgttccggtcgggaccttccaaccccggtaccaaacccaaccctaaaactaccgagttacggaacggtcggttccgggtccccggtccggaacgggtccctaccggaaagggggaacggtaccgggggcccgggtaggttacggggtccttacgtttaacggttttatttacgtcggtaccgtacggtccgacctaactacgtttcgaccgactaacggtcccgtccgggtggtacccgggggtcccgtttaccaacctcgtcccgtaccgaagggttaacaacccttaaaccgttaccgaaacggtaaaccggttacgggttaacttaacctacgtttaaacaaacggttccgtaaacgtaccgtaggacggtaacgtaccggaagacccgaccggttaccgtacttaacgtttacgaggttaaccggaagaacggtanaccggtaacgaccgggaacccgggttacccgggtcccggtagggtccgggttcggttagggtcggtttcgtttacgtttacggtgttcgggnggttacccggggtacccgggg

SEQ ID NO: 106612 - DNA, 935 bp, Homo sapiens
  misc_feature: GYAE6OF01CZSNP.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaagttgggctgagctgggttttccttgttgcttattttagaaggtgtccagtgtgaggtgcagcgtgacggagtccgtgggaggagtacgttcggtcccgaacggggtccccggggggggtcccctggacggtaccttcccgttcccgtggcctaagttacggttacctaccgtaaagttagttttagttacgtttacgtaaacggtttaaattttaggtttagggtaagttacgggaacggttccggttccgggggttacccccgacccggacggggttcccttacccgggggaaggggggaaccgggggttccgtaggggtacggggttacgggggtaccggaacccgaaaaccgtaaaaggttaaaacgggaaccgtaaccgggtaagtacggggtaaagtaacgggtaaacgtaaaaccggtaggttaacgttcgggttagggtacggtttacggtaggttaacggggacggggtacccttaagttacccaaccgtacttcccgtaaccggaacggtaccgaaaccgtaaccccggaacccgtaaacgaaaccgttacccgtaacttacggttaaccttaccgggtacgaccgtaggtaagttcggaccgaccggtccgtaaccggagggaacggacgggtaccggaacgggtaccggaacccgttgttaccgttaagtttaccgtaacggttccgggtaggtaaccgggttaaggggttaacgtttttactttaccgggttacgtttaaggttaacggtttacggtttaacggttaacccgtttaacccgttacccgtttaaacccg

SEQ ID NO: 106613 - DNA, 871 bp, Homo sapiens
  misc_feature: GYAE6OF01AGUOJ.13.71.G05.1.454.CMB.1.raw
  modified_base (234)..(234): a, c, t, g, unknown or other
  misc_feature (234)..(234): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaagttggggctgagctgggttttcctgttgcttattttagaggtgtccagtgtgaggtgcagctggtagagtcggtgggggaggtgtgggtacggccggtgggggtccctnagacctctccgtgtcgacctaacctcgtggtacttcgagtatttgagttacggagttagtggactaactaccgtacggtccggggtaccccaccctaacccgtccgggaaggggggaacggtctcggacggtaggttcgggtaccttacggtaagggtaacttaaaacggtggtaaaggttcgggaccgaccgacgaacctaaaccgttaaacgtttcgacgacgtaacgttaccgttcgggttaagggtaaccgggtaaccggtaacccggtttacttaccctaaaccgtacttaccccgtaaacggagggaaaccgtacggttaaggacccggtaacccggaaaccggtaaaccccttaccgttaaccgtaccttaaccggtacgaaaccgttaaaagtaccggtaaacccgtacgggtttccgaaaccggggtaaccggtaaccgggtaaaccgggtacccgttacccgggttttaccgtttaaggttttacttcggggttaacgggtccgggttaaacgggttaacgggttccggaacggtttcggggtaaccgttacccgtttaacgggttaacctaacgggaccgtttaaaggggccggggttaacccgggttcggggtaaaccccggggg

SEQ ID NO: 106614 - DNA, 970 bp, Homo sapiens
  misc_feature: GYAE6OF01C1ZQE.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgcttattttggaagtgtccagtgtgaggtgcaacgtggtggagtcggtgggggaggtcttggtccagtccggtggggggtcccctggacgtaccttcctcctgtcaacgtccttcgtgggttacacgtcttacgagtagttattagttggagttgacggtcgttacgggtcccgtccacggtaccgtaccgggagggggaaacggggtcgtaggggtagggtcgggggttacggaacccaaacgaaaaccgttaaaacgaaccgtaaacggaaccgggaaacggttaccgaaacccgtaagttaaaccgtagtcggtaccgtaacgttcgttacgggtacggtaaccggggtaccgtaacgtttaccgaaacccttaccgttccgttaacccgaaacggtaaaccgaaaccgtaaaccccggaacccgtaaaacccggtaaaccccgttaaccttaaacccgtttaaagtttaaacgttttaacgggtaaacccgttaaaacgggtacccgggtaaccccggtacccgggtttaaggaaacgggttaaaccgggaaaccggggaaaccgggtaacccggttaaccgggttaacccggttttaacgttaaaccgggttttaaccgttttaacggtttcggttaaccggggtaaccgggtaaaggtaaagggttaaccgtaaggggtaaacgggttacgggttacgggttaaaccggttaacccggggtaaccgggggtttaccgggggggtaaaccccggggttaaacccgggttccgggttaaccccggtaacccggtttaacccgtaaaacccccgg

SEQ ID NO: 106615 - DNA, 895 bp, Homo sapiens
  misc_feature: GYAE6OF01CXX2J.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagagactcaccatggaagttgggctgagcttgggttttccttgttgcttattttagaaggtgtaccagtgtgaggtgcagcgtggtggaggtcgggtgggggggtcttggtcccgaggtcccgggttcggggggtcccctggacgtaccttccgtccgttggtcgaccgtacggtcccgttacggttcggggttacccaccggttcgacggtacccaacctaccctaacagttcggacggtccggtaccggggtcccgaccggaacgggtaccgtacccggggaaagggggtaacggggtccgtagggtacggtcggttcccgttttacgttttacgttttttaaagtttaagttaaggttaggttacggttaacgtacgtacgttacccgtccggacgtacggtaccgtaccgggtagggtacgggacccttatacccaactacgttcccgtacgaacgtaacgaaacccttaaccgtacccgaaaagtaaccccgtaccgttcgttttaaccgtttaacgtaaaccgaaagttaccgaaactcggtacctaggaccggtacgaccggtaagtacgggaaaccgtcccgggttaaccgttagtttaacccgtagttccggaacggtaccggaaaggtaaccgggttacccgggaaccccggggtaaccccttaaaacgggttaaacccgtttcccgaaacgggtacgtttaccgggtagggtacccccgtttacggggaacggggttaacccggaaaccgggttcccggttaacccggtaacccccg

SEQ ID NO: 106616 - DNA, 363 bp, Homo sapiens
  misc_feature: GYAE6OF02GLCQJ.13.71.G05.1.454.CMB.1.raw
  modified_base (358)..(363): a, c, t, g, unknown or other
  misc_feature (358)..(363): n is a, c, g, or t
tcagtcacgtactacacgaccggtgctcgatttagtgtcgtcgcaagagagagggcaggacagggccacggacagtcagcttccttgtgacgcccggagacggaaggtatgtgggcggctgggattttgtggagtgaggatggacattctgccattgtgatgacgactgctactacggcatggacgtctggggccaagggaccacggtcaccgtctcctcagcctccaccaagggcccatcggtcttccccctggcaccctcctccaagagcacctctgggggcacagcggccctgggctgccctggtcaaggactacttcctagtacgtgactgagcgggctggcaaggcgcatagnnnnnn

SEQ ID NO: 106617 - DNA, 543 bp, Homo sapiens
  misc_feature: GYAE6OF02GHBV2.13.71.G05.1.454.CMB.1.raw
tcagtcacgtactacacgaccggtgctcgatttagtgtcgtcgcaagagagagggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtcttccaaggccaggtcaccatctcagccgacaagtccatcagcaccgcctacctgcagtggagcagcctgaaggcctcgggacaccgccatgtattactgtgacaaaatcgcatactacggtaattcaccgcttactactacaacggtatggacgtctggggccaagggaccacggtcacccgtctcccgtcacgccctccaaccgacgggccccagtcccggtccttcccccgtggccctacccc

SEQ ID NO: 106618 - DNA, 537 bp, Homo sapiens
  misc_feature: GYAE6OF02GAP5Z.13.71.G05.1.454.CMB.1.raw
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
  modified_base (530)..(530): a, c, t, g, unknown or other
  misc_feature (530)..(530): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccaggggaaggggctgggagtgggtggccaacataaacacagacggaagtgacccatactatgcggactctgtgaagggccattcaccatctccagacgacaacgccaagaactcactatattgcaaatggaccncctgagagacgaggacaggctatgtattacngtgcgagagatggaagagtcggcttacgaggtttcgggggacccggggtaaccctgggtccaccggtntaacccg

SEQ ID NO: 106619 - DNA, 513 bp, Homo sapiens
  misc_feature: GYAE6OF02IT65Z.13.71.G05.1.454.CMB.1.raw
  modified_base (214)..(214): a, c, t, g, unknown or other
  misc_feature (214)..(214): n is a, c, g, or t
tcagtcacgtactacacgaccggtgctcgatttagtgtcgtcgcaagagagagggggggtgcctcagccatggcatggatccctctcttcctcggcgtccttgcttactgcacaggatccgtggcctcctatgagctgactcagccaccctcagtgtccgtgtcccccaggacagacagccagcatcacctgctctggagataaattggggganaaatttgcttcctggtatcagaagaagccaggccagtcccctgtggtggtcatttatcaagataccaaacggccctcagggatccctgagcgattctctggttccaactctgggaatacagccactctgaccatcaacgggctcaggctatggatgaggctgactattactgtcaggcgtgggacagcagcactgcccgctatgtcttcggaactgggaccaaggtcaccgtctaagtcagcccaggccaacccgactcgtccactctcgttcccgcctccctctacgtaccgtgtacg

SEQ ID NO: 106620 - DNA, 538 bp, Homo sapiens
  misc_feature: GYAE6OF02GUEY4.13.71.G05.1.454.CMB.1.raw
tcagtcacgtactacacgaccggtgctcgatttagtgtcgtcgcaagagagaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtggtagtacatactccgcagactcgtgagggccgattcaccatctccagagacaattccaagaacacgctgttcttacaaatgaacagcctgagacgccgatgaccacggccgttagtacttactgtagcgaggagagtcggggaccccaacggtaaccgttactacgctagtcgggacgtcgtggggacccgg

SEQ ID NO: 106621 - DNA, 540 bp, Homo sapiens
  misc_feature: GYAE6OF02GA2EK.13.71.G05.1.454.CMB.1.raw
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
tcagtcacgtactacacgaccggtgctcgatttagtgtcgtcgcaagagagagggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggccctcggacaccgccatgtattactgtgacaaaatcgcatactacgtaatcacgcttacactanacgtntgacgtcgtgggccaagggaccacggtccaccgtctcctcacgccctccaaccgaacgggcccctagtcccggtcccttcccccgtggccctacccccg

SEQ ID NO: 106622 - DNA, 495 bp, Homo sapiens
  misc_feature: GYAE6OF02HAKNP.13.71.G05.1.454.CMB.1.raw
  modified_base (462)..(462): a, c, t, g, unknown or other
  misc_feature (462)..(462): n is a, c, g, or t
tcagtcacgtactacacgaccggtgctcgatttagtgtcgtcgcaagagagaggggggggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcgcctcagggatccctgagcgattctctggctccaactctgggaacacacgcactctcgaccatcagcgggacccaggctgtgatgagctgactattactgtcaggcgtggacagcagcactcgcctccttcggactgggaccaggtcaccgtcctagtcacgcccgaagcccaacccnctcgcctactccttccgtccccaccctctaccg

SEQ ID NO: 106623 - DNA, 544 bp, Homo sapiens
  misc_feature: GYAE6OF02FS44M.13.71.G05.1.454.CMB.1.raw
  modified_base (360)..(360): a, c, t, g, unknown or other
  misc_feature (360)..(360): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggtttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctactgcagtggancagcctgaaggccctcggacaccgccatgtattactgtgctaaaatcgactattaactacgttaattccgaccgtcttaactactacaacggtatggacgtcgtgggaccaagggaccacggtcaccgtctcctcacgccctaccaccaggcccagtccggtccttcccctcggcctacccccg

SEQ ID NO: 106624 - DNA, 556 bp, Homo sapiens
  misc_feature: GYAE6OF02IVP69.13.71.G05.1.454.CMB.1.raw
  modified_base (390)..(390): a, c, t, g, unknown or other
  misc_feature (390)..(390): n is a, c, g, or t
  modified_base (429)..(429): a, c, t, g, unknown or other
  misc_feature (429)..(429): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttcctgttgctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaggggctgggagtgcgtctcttttattatagtagtggtagtacatactccgcagactccggtgacggggccattccaccatctccaganacaattccaagaccacgcttgtttacctcaaattgaacngcctgagagccgatcgacgaccggccgttgtattacgtgttacgacgagagagtccggggacccaacggtaaccgttacacgtcgttaagtcgggtaccgtcggtcgggggaccgaggggtaccccg

SEQ ID NO: 106625 - DNA, 551 bp, Homo sapiens
  misc_feature: GYAE6OF02HXP3L.13.71.G05.1.454.CMB.1.raw
  modified_base (358)..(358): a, c, t, g, unknown or other
  misc_feature (358)..(358): n is a, c, g, or t
tcagtcacgtactacacgaccggtgctcgatttagtgtcgtcgcaagagagaggggagaggagcccagcactgggattccgaggtgtttccattcggtgatcagcactgaacacagaggactcaccatggagttttggctgagctgggttttccttgttgctattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccaggggaagagggccgggagtggggtctcgagttatttatgtcgacggtgccanttctacgcagactccggtggacggggccgttcaccatcctccagagacaattccaaagaacacggtgtatcttacaaatgaacgacctgagagtcgaggacacgcgtctatactgtgacgaagatgcgagagacgggccccgtaacgtggggccgtggtgggacgggttcgttcttgtacgtcgtcgtcgggg

SEQ ID NO: 106626 - DNA, 622 bp, Homo sapiens
  misc_feature: GYAE6OF02GSJXH.13.71.G05.1.454.CMB.1.raw
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
tcagtcacgtactacacgaccggtgctcgatttagtgtcgtcgcaagagagaggagccttagccctggactccaaggcctttccacttggtgatcagcactgagcggacaggagaacgtcgaccataggcatgggctgaactgggtttcctgttgctatttagaaggtgtccagtgtgaggtgcaactggtggagtcgtgggggaggcttggtccagccgtgggggtccctgagactctcctgtgcagcctctggattcacctttagagctattggatgagcgtgggtccgccaggcctaccgaggggaaggggctgggaggtgggtcggcccaagagtaaacgctaaggttggaaagtgaagaaattactagtggtcggaacttcgtggtaggaacgggtccgtattccaacctatcctaccaagacgacaaacgcctaaaggactcacgttgactntcgaacaagtanaaccgagcctaggacgacgaccggagaacctcgggactggttactaaagttcgtgtacggacggtaagtagggtaacggtttacggggggaacgaaggtttaagaaccggcggttaaggtccgggaccttaacggttacttacgtttacggg

SEQ ID NO: 106627 - DNA, 652 bp, Homo sapiens
  misc_feature: GYAE6OF02G779K.13.71.G05.1.454.CMB.1.raw
  modified_base (364)..(364): a, c, t, g, unknown or other
  misc_feature (364)..(364): n is a, c, g, or t
  modified_base (440)..(440): a, c, t, g, unknown or other
  misc_feature (440)..(440): n is a, c, g, or t
tcagtcacgtactacacgaccggtgctcgatttagtgtcgtcgcaagagagaggagcctagcctggactccaagccttccacttggtgatcagcactgagcacagaggactcaccatggcattgggctgaactgggtttcctgttgctattttgaaggtgtccagtgtgacggtgcaactggtggagtcgtgggggaggctttgggtccaggcccgttgggggggtccctaggacgtactcgtcctgtacagtccctcgtggggttccaggcttcagtcgatacgtggatgagtctggggtccactagacctccgagggaacggggcttagggagttcggggcggcccgaaatacgtaaaaacncgaaggaccggaaagtcggaacccaataacgaatggaccggaacttgacgtgaaaggggccaattcaaccgacttnacccgagagaacgaacgacccaaaggaactccaaactataagttcacaaaagttccgggaaccaccgtaggaacgacgaaacggaacgggaaccacggggtaacctagtacgttaagtacctaggtcgaaccgtgacgtaagtcgaaggtagtgggaaccctaggaacggttggggaacccgggaacccgtgggtaccacccggtcaaacgg

SEQ ID NO: 106628 - DNA, 561 bp, Homo sapiens
  misc_feature: GYAE6OF02I1VL3.13.71.G05.1.454.CMB.1.raw
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (469)..(469): a, c, t, g, unknown or other
  misc_feature (469)..(469): n is a, c, g, or t
  modified_base (556)..(556): a, c, t, g, unknown or other
  misc_feature (556)..(556): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctctgggttcagcttcagtgtatattggatgagctgggtccnccagactccgaggggaggggctgggaggtgggtggccaanataaacacgagacggagtnacccatactatgcgactctgtgaagggccgatccacatctacagacacaacgccaaagacctcaacttatatttgactaaagtcggacccgcctagacgaagacggaaggaccacggtnttaagtgtaactttactggtgacgagagtagtggaagaggtggactacggtgggttcgggggaccgggtaccctggtaccaccgttnaaccg

SEQ ID NO: 106629 - DNA, 583 bp, Homo sapiens
  misc_feature: GYAE6OF02F0HRU.13.71.G05.1.454.CMB.1.raw
  modified_base (363)..(363): a, c, t, g, unknown or other
  misc_feature (363)..(363): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccacaagtccatcagcaccgcctacctgacaggtggancagcctagaacggcctacggaccaccgccatgtaattactgtgactaaaatacgacatactacggtaattccaaccgtcttaactactaacgaacggttatagggtaccttcgtacggggcccaaagggaccctacgggtccaccgtcctccgtcacgccctccgaacccgaacggccctaacgttccggtaccctttcccccgtacggccctaaccccg

SEQ ID NO: 106630 - DNA, 521 bp, Homo sapiens
  misc_feature: GYAE6OF02JGVUC.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggggcttggtccagccgtgggggtccctgagactctcctgtgcagcctctggattcacttttagaggtattggatgggttgggtccgccagactccagagaagggactggagtgggtggccaacataaaggagatggaagtgaaagatactatgtggactctgtgaagggccattcaccatctccagagacaacgccaaagaactcactgtatctgcagactgaccagcctgagagtcgaggatacggctgtgtattattgtgcagagagtggggacaggactagttttgagaggttgtacgtggggccaggggtaccg

SEQ ID NO: 106631 - DNA, 612 bp, Homo sapiens
  misc_feature: GYAE6OF02GYMPA.13.71.G05.1.454.CMB.1.raw
tcagtcacgtactacacgaccggtgctcgatttagtgtcgtcgcaagagagagggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatcggcccgggaaaggcctggagtggagtggggatcatctatccgtggtgactctgactaccagatacacgccccgtccttccgaaggccacggtccaccatcctcacgccgacaacgtccatcacgccacccgcctacctgctaggtcggacgcacgcctaggaaccggcccgtacggaccaccgcctagtacgtacttacgtgtacgaactaaaacgtaccgactacttaacgtacgttaacttcgaccgtaccttaactactacgaacgtagtcggtacgtcgtacgggaccgaacggacctacggtcctaccgtctccgtcacgaccctaccaaccgacggccctacggtccgttaccctccccgtcgtccctaccccg

SEQ ID NO: 106632 - DNA, 568 bp, Homo sapiens
  misc_feature: GYAE6OF02H3SC5.13.71.G05.1.454.CMB.1.raw
  modified_base (451)..(451): a, c, t, g, unknown or other
  misc_feature (451)..(451): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctctgggttcagcttcagtgtatattggatgagcgtgggtccgccagactccgaggggaaggggcgtggaggtggggtgaccaaacaataaacacaaggacggaagtcgaacccatactatgcggactctggtagaacgggcgattcgaccatcctcagacacgaacgaccaagaactcactatatttgacaaagtggaccnctgagagacgaggacgacggtactatgttaacttacgtagngcgaagngaagtggaagtggtggcctagacggggttggggacccgggtaaccttcgggtacacccggttacaaccg

SEQ ID NO: 106633 - DNA, 538 bp, Homo sapiens
  misc_feature: GYAE6OF02GNT4V.13.71.G05.1.454.CMB.1.raw
  modified_base (438)..(438): a, c, t, g, unknown or other
  misc_feature (438)..(438): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccgaggggaaggggctgggagtggggtggccaacataaacacagacggaagtgacccatactatgcggactctgtgaagggccgattccaccatctccagacgacaacgccaaagaactcactatattgacaaatggacccnctgagagacgaggacacggctagtgttaattcgngtgcgagagatggaagngtggctacgagggttcggggcccgggtaacctgggaccaccgtcaaccg

SEQ ID NO: 106634 - DNA, 554 bp, Homo sapiens
  misc_feature: GYAE6OF02IEY0J.13.71.G05.1.454.CMB.1.raw
  modified_base (290)..(290): a, c, t, g, unknown or other
  misc_feature (290)..(290): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
  modified_base (505)..(505): a, c, t, g, unknown or other
  misc_feature (505)..(505): n is a, c, g, or t
  modified_base (546)..(546): a, c, t, g, unknown or other
  misc_feature (546)..(546): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagattctcctgtcaagcctctgggttcagcttcagtgtatattggatgagctgggtccnccagactccgaggggaaggggctgggaggtgggtggccaacataaacacagacggaagtcgaccatactatgcgactctgtgaacgggccattcaccatctacagacaacaacgcaaagactcactatattgacaaagtggacccnctagagagacgaggaccaggctagtgtaacttacngtagcgaagagaagtggaagaggtggacctaagngggttcggggggacccgggtaacccttgggtcctaaccggntaaacccg

SEQ ID NO: 106635 - DNA, 714 bp, Homo sapiens
  misc_feature: GYAE6OF02FUFH8.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttaaaaggtgtccagtgtgaagtgcagctggtggagtcgtgggggaggcttggtacagcctggcaggtccctgagactctcctgtgcagcctctggattcacctttgatgattatgccatgcactgggtccgcaagctccgagggaaggcctggagtgggtctcgaggtattagtggaatagtggtagcagtacggctagtcggcggtacttcgtaggtaggaaacggggtcccgtaagttaccaacccgtaacgttccgtaacccgtaaggaacggaaaacccaaacccgggaaccccaaaacggtaaacccgttaccccgttagttaccgttacgttacggaacctaaaactcggaaaacaccggacccgttacggaaggaacggtacgttagggaaaccgggtaccgaaccgggttacccgtttaggttactttacggttaggttaacggaaccgtaaaaaccggtccgttaaccccgttaaacccccgtttacggtttaacgttttttacggggaagttttacggggtttacttaacccgggttaacggggg

SEQ ID NO: 106636 - DNA, 575 bp, Homo sapiens
  misc_feature: GYAE6OF02JIR7O.13.71.G05.1.454.CMB.1.raw
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
tcagtcacgtactacacgaccggtgctcgatttagtgtcgtcgcaagagagaggagccttagccctggactccaaggccttccacttggtgatcagcactgagtacagaggactcaccatggaattggggctgagctgggttttccttgttgctattttagaaggtgtccagtgtgaggtgcagctgacggagtctggaggagacttggtccagcctggggggtccctggagactcctcctgtgcagcctctggttcaccgtcagtccacacctanatgagctgggtccnccaggctccgaggggacgggctgggagtgcgtctcttttattatgtagtggtagtcatactccgnagtactccgtggacgggccattccaccatcctaccagacgactaattaccaagaacacgtcttacgtttcttaacaaattgaaacagccctgacgagcccgtatcgaccacggggtcctagttacttacgngtcgcgtagacgngtcggggacccaacggtaacgtttcacggtactagtcgggacgtcggtcgggggaccctaaggggaccctaccggg

SEQ ID NO: 106637 - DNA, 621 bp, Homo sapiens
  misc_feature: GYAE6OF02HV77T.13.71.G05.1.454.CMB.1.raw
  modified_base (251)..(251): a, c, t, g, unknown or other
  misc_feature (251)..(251): n is a, c, g, or t
  modified_base (480)..(480): a, c, t, g, unknown or other
  misc_feature (480)..(480): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggggggcttggtccagccgtgggggtccctgagactctctgtgcagcctntgggttcaccgtcagtcacacctacatgagctgggtccgcaggctccgagggaggggctgggagtgcgttcttcttttattatagttagtggtagtacattacctccgctagactccggtggacggggcctattccaaccacttcctaccgagaacgactaacttaccgaaagaaccacgtctttacgtttaccttacaaatgaaaccacgtcctagacgacgaccganacgacgaccggtccgtagtacttacgtgtcggacgtaagaggacggtcggggacccaccggtaaacggttactaaccggtcttaacggtcgggtacggttccggtacggggacccggtaacgggacccgtacggtaccccg

SEQ ID NO: 106638 - DNA, 768 bp, Homo sapiens
  misc_feature: GYAE6OF02IJGFC.13.71.G05.1.454.CMB.1.raw
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
tcagtcacgtactacacgaccggtgctcgatttagtgtcgtcgcaagagagagggggggatcaaccgccatccttgccctcctcctggctgttctccaaggagtctgtgccgaggtgcagctggtgcagtctggagcagaggtgaaaaagcccggggagtctctgaagatctcctgtaagggtttggaaacngctttancagccactggatcggcgtgggtgcgccagatcggaccccgggaaaggcctagggagtggagtgggatcatctatccgtggtgactctgaactaccagactacgacgtcccgtccttaccgaaggccctaggtccaccacgttccacgacgacccgaactaacgtcctagccaacgtccccaaccgtcccttacccgtagtcccgaagggtcggacgaccaccggtacccgtagggaacccggtcccgaaccgggtaacccgaccccgtacccgtagttaccggtttaaacttaccgttagtaccggaaacctaaaaccgttccggaaccgttaacttaaccgttaaccggtaaacttcccaacccggttactttaaccttaaccgtaaccggtaacggtacgtacggaccgttaccggtacggggaacccgaacggaacccgtaccgggtacccgtaacccgttcccgtacccttacgacccgttacccccgtaacccggtaacccggtaaccgggtacccccgtacggttccccggttacccccgtttaccccccgaccggtaccccc

SEQ ID NO: 106639 - DNA, 770 bp, Homo sapiens
  misc_feature: GYAE6OF02GHUH8.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggggcttggtccagccgtggggggtccctgagactctcctgtgcacgcctcgtggtacttctaacttttaggtaggttagttggtagttggggtttcgggtcccgccgaggtacctccgaaggaaggaaacggggtacgtgggaggtggggtcggaccaacgaagtaaaaggaagtagtaggaagtagaaagataactatggtgacttcgtggtaggaacgggtccgtacgttaccgaaccctattacccgtaccgaaggtaacgaaccgaaaccgacccgaaaagtaaccctacctaaccgttaggttaacttcgtccggacgtaacggtacgtaccgaacccgtaaccggtccctagggtaaacgggacggttaaccgggaagggtaaacgggttaaccgggtcggtttacggtttaaggtttaagttttacggtttgggtacgaacggtagggaaggtaggggtcgggggaacccgtaacggttacgtttaacggtttttagggaaggttacggggttacggttaacgggggtcggggacccgggtagggggtaaccccccgggg

SEQ ID NO: 106640 - DNA, 624 bp, Homo sapiens
  misc_feature: GYAE6OF02H3DSP.13.71.G05.1.454.CMB.1.raw
  modified_base (547)..(547): a, c, t, g, unknown or other
  misc_feature (547)..(547): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggggcttggtccagccgtgggggtccctgagactctcctgtgcagtcctcgtggattctactttttaggtaggttattgggagttggggttgggtcccgcgagactcgaggaggaaggggctagggaggttggggcggacctaaacaagtaaaacggggaagagtgggaaagtagaaagtatactagtggtagactcgtggtaggaaggccattccactactcctaccgaaggtacgacgaaaccgaccaaacgactacaactcgtaactctcgacgagatacgacctacgtccgtggaacggcgtacggaaggcgtacggtatggtagttaattagttggtcgngaggagtcggtgggacaccgtaattagttttaggtaggtaggttaggtacgggtcggggtaccggtaggggacccgg

SEQ ID NO: 106641 - DNA, 532 bp, Homo sapiens
  misc_feature: GYAE6OF02JIP36.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccactgtgagctgcagctggtggagtctggggggggcttggtaaagcctgggggtcccttacactctcctgtgtagcctctaaaatcactttcaacgacgcctggatgagctgggtccgccaggcgccagggaggggactggagtgggttggccgtattaaaagcgaggccgatggtgggacagcagacttcgctgcaccgtgcaagccagattcaccctctcaagacatgatttagagaatctgtatatttgactaaatgaacagcttgacaacgaggacgcaggtcttagttactgtgccagttacgtcacgtggcctactctacttctttgacttcgtgggcccagggtaccctggtccg

SEQ ID NO: 106642 - DNA, 531 bp, Homo sapiens
  misc_feature: GYAE6OF02GEDGD.13.71.G05.1.454.CMB.1.raw
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
  modified_base (471)..(471): a, c, t, g, unknown or other
  misc_feature (471)..(471): n is a, c, g, or t
  modified_base (526)..(526): a, c, t, g, unknown or other
  misc_feature (526)..(526): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagccgtggggggtccctgagactctactgtcaagcctctgggttcagcttcagtgtatattggatgagctgggtccgccagactccgaggggaaggggctgggagtgggtggccaacgataaaacacagacggaagtcgacccatactatgcggactcgtgtgaagggccgattcaccatctccaganacaacgccaagactcactatattgacaaatggaccncctgagagacgaggacacggctagtgtatctgtncgagagatgaagagtggctagaggttcggggacccgggtaacctggaccaccgtnaaccg

SEQ ID NO: 106643 - DNA, 682 bp, Homo sapiens
  misc_feature: GYAE6OF02IHDID.13.71.G05.1.454.CMB.1.raw
tcagtcacgtactacacgaccggtgctcgatttagtgtcgtcgcaagagagagggggggggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttgggggataaatatgcttgctggtatcagcagaagccaggccacgtcccctgtgctggtcatctatcaagactaaccaacggccggccctcgacgggactccccgtgacgcgtattctcgtcggcctccaactcgtgggaacacgacgccactctacgacctatcgacggccgggacccgaggcgttggtagggagtcgggacggtcttagacttaacgtttacgtggttaccggagggtccgggttagggaaccacggaccgacgccgtaccgtccggtaccccgtttccggttaccgggaaccgttaccgggaacccggtaacggttacccgtacccgggttaccggtacgggttaccggaacccggtacccgtaaaccccgggacccctaaacccccgtacgttacccggtccctaacccgtttcccgttaccccggttacccccgttcccccgttaccgtttaaccccgg

SEQ ID NO: 106644 - DNA, 720 bp, Homo sapiens
  misc_feature: GYAE6OF02JNRVS.13.71.G05.1.454.CMB.1.raw
tcagtcacgtactacacgaccggtgctcgatttagtgtcgtcgcaagagagagggggggggtgcctcagccatggcatggatccctctcttcctcggcgtccttgcttactgcacaggatccgtggcctcctatgagctgactcagccaccctcagtgtccgtgtcccccaggacagacagccagcatcacctgctctggagtataaagttggggaataatatgcttgcgtggtatcagcaagagccaggccacgtccctgtgccgtgtactatcgtatacgaagactaccgaaggccggaccctacgacgggtactccccgtaggacggtaccgtacttcgtccggtcggtaccctacccgtaaaccgtccggttaaccgggtaaaccaaccggtaccgtaccctaccgttaccgtacgaaacctacgtacccggacgggacccgggacccgtacggtccgttaggcgggtactacgggtacgtcccgttaggtaaacctttaggtttaccgacggtccggtaaggggtccggtacggggaacacggttacgacgtacctacggtccgtaacccgttccgtacgggaacgttcccggggaactacggtaccgaccgttaccgggacgtacccgccgaaccccggaaccgtaccccgtaaccctacgttccgtaaccgtccgttcccgttcccggttacccccgccgtttaccctaacgg

SEQ ID NO: 106645 - DNA, 824 bp, Homo sapiens
  misc_feature: GYAE6OF02HKWSV.13.71.G05.1.454.CMB.1.raw
tcagtcacgtactacacgaccggtgctcgatttagtgtcgtcgcaagagagagggggggggtcaaccgccatccttgccctcctcctggctgttctccaaggagtctgtgccgaggtgcagctggtgcagtctggagcaggaggtagaaaaaggcccggggagtctctgaagatctcctgttaagggttttggaaacagtctttatcagccactggatcggctgggtgcgccagtagtcggacccgggaaaggccgtgggaggtggagtggggatcatctactccgtggtacgtactctagactaccgagactacgacgcccgtccttaccgaaggtccgaggtccacctactctacacgaccgtaacaacgtccaactcacgtacccgacccgacccttaccgtcgacctaagggtcggaacggccgtaacgtcccgttagggaaccggtcccggttaccggaaccgaccccgtaccgtacgtttacgttaactttaacggtcgttaacggtaaactaaaacgtaccggactaaacgttaaccgtttaaaccggtaactttaacccggaacccggtttaacctttaacccgaaacgtttaaacccgaacggttacgtacgggaaccggtttccgggtaccggggtaaacccgaaacggggacccgttaaccggggtaccctaccccgttaccggttccgtacccggttaacccgtacccgtaacccccggtaaaccggtaacccgggacccccttaaccgggttttccccgggttacccccccgtttaaccccggtcccgtaacccccccgttaaccccccgg

SEQ ID NO: 106646 - DNA, 533 bp, Homo sapiens
  misc_feature: GYAE6OF02JAOG0.13.71.G05.1.454.CMB.1.raw
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (428)..(428): a, c, t, g, unknown or other
  misc_feature (428)..(428): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagtcacgtactacacgaccggtgctcgatttagtgtcgtcgcaagagagaggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtggggggtccctgagactctcctgtgcagcctctgggttcaccgtcagtcacacctacntgagctgggtccnccaggctccgagggagggctgggagtgcgtcgtcttttattatagtagtggtagtacatactcgcaagctccgtgacgggcattcacntctcagagactatccaagacacgctagtttcacaaatcgaaacngcctagacgtagccagtacgaccacgggccgttagtacttacgngtacgcgagacgngtccgggccaagtaccgttanccgtatagnggacgtcgtcgggaaccg

SEQ ID NO: 106647 - DNA, 386 bp, Homo sapiens
  misc_feature: GYAE6OF02JFQVT.13.71.G05.1.454.CMB.1.raw
  modified_base (371)..(386): a, c, t, g, unknown or other
  misc_feature (371)..(386): n is a, c, g, or t
tcagtcacgtactacacgaccggtgctcgatttagtgtcgtcgcaagagagaggggcaggacagggccacggacagtcagcttccttgtgacgcccggagacggaaggtatgtgggcggctgggatttttgtggagtgaggatggacattctgccattgtgatgacgactgctaatacggcatggacgtctggggccaagggaccacggtcaccgtctcctcagcctccaccgaagggcccatcggtccttccccctggccgccctgcctccgaggagccacctccgagagccacagccggccctgggcctcggcctggtccaaggtctaccttcctagtacgtgactgagcggctggcaggcgacatagnnnnnnnnnnnnnnnn

SEQ ID NO: 106648 - DNA, 717 bp, Homo sapiens
  misc_feature: GYAE6OF02GO1I1.13.71.G05.1.454.CMB.1.raw
tcagtcacgtactacacgaccggtgctcgatttagtgtcgtcgcaagagagaggggagaggagcccagcactgggattccgaggtgtttccattcggtgatcagcactgaacacagaggactcaccatggagttttggctgagctgggttttccttgttgcttaattttaaaaggtgcccagtgtgaggtgcagcgtggtggagtctgggaggaggcttgatccagccgtgggggtccctgagactctcctgtgcagcctcgtgggttccaccgtcagtcaccacctacatgagcgtgggtcccgccgaggcctaccggaggggaacggggcgtgggagtcggtcgttctttactttttaatttagtaaggttaggttacggttaagtaactattaccgtccgacgtacgtaccgtccggtggacggggtaccctagttccaaccattacctacccgaagaacgaacctaaacttacccgaaaacgaaccgacgtaccgttagttttaccttaacgaaaattacgaaacgtacgaccgttagacgtaacggacccgtagtaccggaaccgtaccgggtaccgtttagttaacgtttaaccgtggttacggacgtaacgggacggtaacggtaccgggggacccctaaacgggttaacccgttaaccgttaccgtacgttacggttaccgggaacgttccgggtaccggggaacccgg

SEQ ID NO: 106649 - DNA, 716 bp, Homo sapiens
  misc_feature: GYAE6OF02GKWB9.13.71.G05.1.454.CMB.1.raw
  modified_base (283)..(283): a, c, t, g, unknown or other
  misc_feature (283)..(283): n is a, c, g, or t
tcagtcacgtactacacgaccggtgctcgatttagtgtcgtcgcaagagagaggggggggggtgcctcagccatggcatggatccctctcttcctcggcgtccttgcttactgcacaggatccgtggcctcctatgagctgactcagccaccctcagtgtccgtcgtcccccaggacagacagccagcatcccactgctctggagataaagttgggggaataaatttgacttcgtggtatcgagaagaagccaggccacgtcccctggtggtggtctatttancaagataaccaaccggccctacaggggactcccgtggacgcgtattcgtcgttcggttacccaacttcgtagggaaattacgacgccactcgtacgacctataaccggaaaccgggtactacggaggtactacgtaggtaagtggacggtcttacgtaacttaacgtttacgtaggtacggtagggtcggtacggggacacgggaccgaagtcccgaacgttccggaccccgtacgttacgttccggttaccggttaccgggaacggttaccgggaaccgtaacggtcccgtaacccggtactaaccggtacgaccgacccgaaccgaccccgtaacccgtacgttacccgtacccgtaccgtttcccgttacccggtttccccgccccgtttaccccgttaccggtttaacgggtacccgtacggtaccggg

SEQ ID NO: 106650 - DNA, 780 bp, Homo sapiens
  misc_feature: GYAE6OF02FH8BA.13.71.G05.1.454.CMB.1.raw
  modified_base (198)..(198): a, c, t, g, unknown or other
  misc_feature (198)..(198): n is a, c, g, or t
  modified_base (702)..(702): a, c, t, g, unknown or other
  misc_feature (702)..(702): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtagaaaaacgcccggggagtcctctagaagatctcctaggttaaggtttggaaacngctttatcagccactggactcggcgtgggtcgcgccagactcggaccccgggaagcctggagtggagtggggatcgatctactccgtggtacgactctacgactacgacgactccacctccccggtacctaccgaacgaccgtacggtaccacctactccgtacgacggacctaaccgtaaccgttacccacgtaccgaaccgtacccgtaccccggtaccctaaccgtcggtaccgtaacgggtaccggacggtaccgtaaccggtacccgtaacgggtacccggtacccgtacccgggaaccccaacccggtccttaagtttaccggttaacctttaccggtacggtaaccgaaaaccgtaaacccttccgaaaccttaacggttaaaacccgtacggtttaactaccccggaccgtttactttaaaccgaacgttacggaacggttacgtacggtaccgtacggtccgggaacctaacgggcccgtccgtacctccgtacncgtaccaccgtccctaaccgaaccggacccgttcgtacccgttacccgtcccctaccccggtacgtcccctaaccccg

SEQ ID NO: 106651 - DNA, 653 bp, Homo sapiens
  misc_feature: GYAE6OF02HO0XZ.13.71.G05.1.454.CMB.1.raw
  modified_base (183)..(183): a, c, t, g, unknown or other
  misc_feature (183)..(183): n is a, c, g, or t
  modified_base (555)..(555): a, c, t, g, unknown or other
  misc_feature (555)..(555): n is a, c, g, or t
  modified_base (606)..(606): a, c, t, g, unknown or other
  misc_feature (606)..(606): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgcttattttagaaggtgtccagtgtgaggtncaactggtggagtcgtgggggaggcgttggtccagccgtgggggtcctggagactctctgtcaagcctctggttcagcttcagtgtatattggatgagcgttgggtccgccagactacggaaggggagggcgtgggaggtgggtcggaccaacaataaacgacgaggaacggaagtcgaccaatacgtatcggcgtactcgtggtagggaacggcctaagttaccaccgtatccgtaccaaggaacgaaccaaacggacccaaagtaaccctcgaaacttatttacgttagaacgtaaagtcgggaccctaccgtaggaaacggtagaacgggtaaacgaccgtacggtacttaggttacgtaatttaccgnggtacgacgtaaggacgttacggtaggacgtggtacgtaaccgttaacggnggggttacccggggaccgggtaccgtacggtcccgaacccgtacacg

SEQ ID NO: 106652 - DNA, 776 bp, Homo sapiens
  misc_feature: GYAE6OF02HX2F9.13.71.G05.1.454.CMB.1.raw
  modified_base (619)..(619): a, c, t, g, unknown or other
  misc_feature (619)..(619): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagcgttgggttttccttgttgcttattttagaaggtgtccagtgtgaggtgcagctggtggagtcgtggggggggcttggtccaggccgtgggggtccctgagtacctctcctgtcgcagtcctcgtggtacttctactttttaggtaggttattggagttgggttggtccgcgagactcgaggaagaggactgggaggtgggcggacaacgagtaaaaggacgagtagggaagtaggaaagatactatggtagacgttctaggtaggaacgggtccgtaacttaccgaaccacgttaccgtaccgagtaaccgaacgtaaacccggaaccaaaacggtaactccgtaacttacggtaactaccgttacggactaacggtaagtaccggaaccgtaacggttcccgtaaggggtaccgtacgggaaacgggttaacggttaccgggtacgtttcggttacgggttttaaactttaggtttacggnggttacggaagggttagggaaccgggttaccgggggaccgtaaccgggttaaccgtttaaggttttttacgggaaagggtttacgggggtttacggtaaacccggggttccggggggtaaccgggtacccgggggtaccccggttaaccccccgggg

SEQ ID NO: 106653 - DNA, 637 bp, Homo sapiens
  misc_feature: GYAE6OF02H7B4M.13.71.G05.1.454.CMB.1.raw
  modified_base (284)..(284): a, c, t, g, unknown or other
  misc_feature (284)..(284): n is a, c, g, or t
  modified_base (369)..(369): a, c, t, g, unknown or other
  misc_feature (369)..(369): n is a, c, g, or t
tcagtcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtagaaaaagcccggggagtctctgaagatctcctgtaagggttttggaaacagctttatcagccactggatcggctgggtgcgccagatcggcccgggaaaggcctgggagtggagtggggatcatctatccgtggtgactntgataccagatacacgtccctccttaccgaaggccaggtccaccatctcgacgccgaacaacgtccatcacgccaccgcctaccngccagtcggagcacgtaccgtaggaacggcccgtcggaaccacccgccatcgtaacttactggtagaacaaaatcgactaattaaccgtaacggtaattccgaccgtactttactaactaacgtaacggtagtacgggtacgttcgtacggggaaccgtaacgggaccgtaccggtccaccggttccttacccgacaccgtccctacccgaaccgtaaccggcccctaggttcccgttcccgttacccccgtcggaccctaccccccg

SEQ ID NO: 106654 - DNA, 535 bp, Homo sapiens
  misc_feature: GYAE6OF02FLNNS.13.71.G05.1.454.CMB.1.raw
  modified_base (272)..(272): a, c, t, g, unknown or other
  misc_feature (272)..(272): n is a, c, g, or t
  modified_base (360)..(360): a, c, t, g, unknown or other
  misc_feature (360)..(360): n is a, c, g, or t
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggggggcttggtccagccgtgggggtcccctgagactctcctgtgcagcctctggattcacttttagagtnttggatgggttggtccgcagactccagagaagggctggagtggggtggccaaacgataaaagggaagatggaagtggaaagatactangtggactctgtgaagggccattcaccatctccaganacaacgccaaagaactcactgtatctgcagatgaccngctgagagtcgagtacgtacggtctagttagtatttagttgtgacgagagagtgggacacgatagtttgaggtggtgtaggtcgggtaccgtagggacccgg

SEQ ID NO: 106655 - DNA, 610 bp, Homo sapiens
  misc_feature: GYAE6OF02GJW1R.13.71.G05.1.454.CMB.1.raw
  modified_base (501)..(501): a, c, t, g, unknown or other
  misc_feature (501)..(501): n is a, c, g, or t
  modified_base (531)..(531): a, c, t, g, unknown or other
  misc_feature (531)..(531): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaacttgggttttccttgttgctattttagaaggtgtccagtgtgaggtgcaactggtggagtcgtggggggaggcttggtccagccgtgggggtccctgagactctactgtcaagcctcgtgggttcagcttcagtgtatatggatgagcgtgggtcccgccagacctccgagggggaaggggcgtgggaggtgggtcggaccaaacgaactaaacacgaggaacggaagtcgaacccatactatggacggtactcgtggtaggaacgggccgtattcacctactcctaccgagaacgaccaaacgacccaaaagaacctacgaacttattacttgactaaagtcgaccgctagagagacgagaccnggtctagtgttaattctgtgacgagagtanggtaagaggtcggtaccttacggagggtttcccggggggacccgggtaacccgtggtacccgtacccggtagtaacccg

SEQ ID NO: 106656 - DNA, 691 bp, Homo sapiens
  misc_feature: GYAE6OF02G53MH.13.71.G05.1.454.CMB.1.raw
  modified_base (168)..(168): a, c, t, g, unknown or other
  misc_feature (168)..(168): n is a, c, g, or t
  modified_base (276)..(276): a, c, t, g, unknown or other
  misc_feature (276)..(276): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgcttattttagaggtntccagtgtgaggtgcagctggtggagtcggtggggggggcttaggtacagccgtggaacggtccctgagtactctcctgtgacagcctcgtggtattcctacctttancagtctatcgccatcgaccgtcgggtcccgccgacggccgtccgaagggggaacggggtcgtgggtccgggttgggtccttacggtacggttaagtttagggttcgggtaggttgggtaggaacgacaacgacgtaccgtacgacacggtacccgtccggtacggtaacggggtcccggttaccgaaccctacgtccctaccgaagaacgaacctaaacttacccgaaacgaacctaccgacttagttacgtacgtacgaactaaagtacgaaaccgacgtaccgtagaacgaccggaccggaacggaccggaacccggtaccttaagtacttaacgtgtacggacaggaccgtaaggtcggtacgccggtacaacggaggtcacgttaattaacgtttaccttaggtaacccgg

SEQ ID NO: 106657 - DNA, 560 bp, Homo sapiens
  misc_feature: GYAE6OF02GEIOS.13.71.G05.1.454.CMB.1.raw
  modified_base (390)..(390): a, c, t, g, unknown or other
  misc_feature (390)..(390): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
  modified_base (533)..(533): a, c, t, g, unknown or other
  misc_feature (533)..(533): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggggggcttggtccaggccgtgggggtccctgagactctcctgtgcagtcctcgtggattcactttttaggtaggttagtttgggagttgggggtttgggtccccgtccagacctccgaggaggaaggggacgtggggagtggggtcggccaagagtaaaggagatagggaagtgaaagatactagtgnggactctggtgacgggcgtattccncactctacnganacaacgccaagactnactgtatcnacangtacgacngcctgagagtcgagtacgngctgtgtattgtgngtgagtgaggtggactacgtattacggtttgacgggngttggacgggtcgggccgtagggcccg

SEQ ID NO: 106658 - DNA, 1016 bp, Homo sapiens
  misc_feature: GYAE6OF02HAER8.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaattggggctgagcttgggttttccttgttgcttattttagaaggtgtccagtgtgaggtgcagctgacggagtcgtggaggagtacttgggtccacgggcccggggggtccctggacgacctcctcctgctatacgtctacgaagtatttagtgttactaagttaatttagttaggattaggacgtcgttacggggtcccgaccgtaggtcctaccgggaagggggtaacggggtcgttacggggagggttcggggtaccggacccgtaaaacgtaagtaaaacggccgtaaaccgggtaagtaacggggtaaaggtacggaaacgtaaaacggtacgttaaggttgggttacgggtaagttaccggtagggttaacggggaaacgggggtacccgttaacgtttacccgaacccttaacgttacccgtaacccggtaaagggtaaacccgaaaacccgaaaaccccggtaacccgtaaaaaacccggtaaacctttaccgaaaccggttttacggttaaaccctttccggtaaccggtaaacgtaaacgggttaacggtaacgggtaaacccggtaaccgtaaaccgggttacccggttaaaggggaaaccgggggtaaccgggggtaaccgggtaaaacccggggaaacccgggtttaaaccggggttcctttaaacggggttttaaatttaacccgttttacgggtacgggggtaacccggtttaaaacggggggtaaacggggttttttaaaaccgtttttaacccgtttttacccggttaaccgggttttaaagggtttaaacccgggttttaaaggggtttttaaccccggggttttttaaaccgggttttaaccccccgtttaaccccggtttttaaaccccggg

SEQ ID NO: 106659 - DNA, 651 bp, Homo sapiens
  misc_feature: GYAE6OF02GS09Y.13.71.G05.1.454.CMB.1.raw
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (495)..(495): a, c, t, g, unknown or other
  misc_feature (495)..(495): n is a, c, g, or t
  modified_base (594)..(594): a, c, t, g, unknown or other
  misc_feature (594)..(594): n is a, c, g, or t
  modified_base (612)..(612): a, c, t, g, unknown or other
  misc_feature (612)..(612): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattgggctgagcgtggttttccttgttgcttattttagaaggtgtccagtgtgaggtgcagtcgtgggtggagtcggtggggggggtcttggtccaggtccggtcgggggtccctgacgaccttccgttcctgtacgcaaccgtcgtggtacttcagtatttgatagagtatggnactacacgtcgggtcccaccacctaccggaggggagggctcgcgtaggtcggtcctgtaggtaataagngagtggcncgagacaactacttgcgacagtactcgtaggtacgaacgggtcctacttcgaccacgttcccgacgagacggtacgtaggccggacccgaacgttaacccgaccgttaagacttccganaacctaaagcgtaaacgcgtcgtacgggtaggtaccgacgtaccgtaccgttcgtttagttcgttcggtagtcgggtacggttggttacacggttcggngttacgtaccggtttacncggaaccgttaggtccgggttacggtccgggtaccgggg

SEQ ID NO: 106660 - DNA, 621 bp, Homo sapiens
  misc_feature: GYAE6OF02G3Q96.13.71.G05.1.454.CMB.1.raw
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
tcagtcacgtactacacgaccggtgctcgatttagtgtcgtcgcaagagagaggagccttagccctggactccaaggcctttccacttggtgatcagcactgagcacagagactcacatggaatggggctgagctggtttcctgtgctattttagaaggtgtccagtgtgaggtgcagcgtggtggagtcgtgggggggcttggtcaggcgtgggggtccctgacgactctcctgtgcgagcctgnggattctactttagtagtaagtggagtggttcggtcgcganactcgagagaaggcnggagtggtgaccgtaacaagtaaagtagataggaagtagaaagatactagtcgtagacttcgtagttaggaaggacctagtacactaatactaccgagaacgaacgtaacgacaaagtactactacgtatacgctagacgtgaacgtacgtaaccagtacccgtaggtacgaacgtacggtaaggaacgtaccggtgtacggttattaaagttagttcggagaccggtaggaggtaacgggttcggaaccgttaccgtaaagtttgtttaacggtagtacgggttacggtaggtacccggacggtaagggtaccccggg

SEQ ID NO: 106661 - DNA, 640 bp, Homo sapiens
  misc_feature: GYAE6OF02HY1QA.13.71.G05.1.454.CMB.1.raw
  modified_base (197)..(197): a, c, t, g, unknown or other
  misc_feature (197)..(197): n is a, c, g, or t
  modified_base (474)..(474): a, c, t, g, unknown or other
  misc_feature (474)..(474): n is a, c, g, or t
tcagtcacgtactacacgaccggtgctcgattttagtgtcgtcgcaagagagagggggggggtcaaccgccatccttgccctcctcctggctgttctccaaggagtctgtgccgaggtgcagctggtgcagtctggagcagaggtagaaaaaggcccggggagtctctgaagatctcctgtaagggttttggaaacngtctttatcagccactggatcggcgtgggtcgcgcagctcggaccgggaaacggccgtagggagtggaggtggggactcgattctactcgtggtacgcgtctgactacgaatactacgaccgtcccgttcccttaccgaacggccgaggtccacctactctacgacgaccgaacgaacgtccatcacgacccacccgtcctaccgtcgctaggcgacgcgacgcgtacggacgccgtacggaccaccgactatacgtattacgtgtactaactaaanacgtactattaacgtagtacttcacgtactacactacgacgtagtcgtacgtcggacggaccgaacggtacctacgacctaccgtcctaccgtccgaccgtcccaacccgtacgaaccggtccgtacggttcccgttacccgtcccgttccggaccctaaccccgg

SEQ ID NO: 106662 - DNA, 850 bp, Homo sapiens
  misc_feature: GYAE6OF02ILJES.13.71.G05.1.454.CMB.1.raw
  modified_base (188)..(188): a, c, t, g, unknown or other
  misc_feature (188)..(188): n is a, c, g, or t
tcagtcacgtactacacgaccggtgctcgatttagtgtcgtcgcaagagagaggagccttagccctggactccaaaggcctttccacttggtcgatcagcactgagcacagagactcaccatgaattgggctgagctggttttccttgttgctatttagaaggtgtccagtgtgaggtgcagcgtggngtagtcggtggggggcttggtcgagccgtggggtcctgacgtcctcctcctgtcgcagtcctcgtggacttacgtacgttttacgtaggttagttaggtagttggggttcggtccccgacgtaacgtacctaccgaggtaaacggaacgggtacgtacggggaaggttcgggggtaccggaccctaaaacggtaacgttaaaaacggggaaataagggttagggtaaaacggttaagaaaaacggttaacgttaacgttaacggttacggtaggttaaccgttcgttaacggtacggtaaaccggggtccgttaacgtttaacccgtaaccaacgttaccgttacccgaaggaacgtaaacccgacccggtaaacccaaacggaaccgttacccaaagttcgttactccgttagaccgaaggtacgtacgaacccgtaaccgtcccgtaaggtaaccggtacgggttacgtaacggggtacctaaccggggttcgttaggttacgttttaacgtttaaaggtttcggtaacggtaccggtaacgggtaggtttaacccggggttaagggggttaacccgggttaaaaggttcgttaacggtaaccggtagggttccggtaaccgttaaccggtttaacgtttaccgttacggttaacccggg

SEQ ID NO: 106663 - DNA, 728 bp, Homo sapiens
  misc_feature: GYAE6OF02JB0WC.13.71.G05.1.454.CMB.1.raw
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
tcagtcacgtactacacgaccggtgctcgatttagtgtcgtcgcaagagagaggagccttagccctggactccaaggcctttccacttggtgatcagcactgagtacagaggactcaccatggaattggggctgagctgggttttccttgttgctattttagaagtgtccagtgtgaggtgcagctgacggagtctggaggagacgttggtccgaggcccgggggggtccctggacgactctccgtgcatagtctcaagtatttatgttacagttaattattggatgagtcgtggtccgccgaggtcctcccgaaggggaacggggtcgtacggggtaggtcggggtacggacccaaacgtaagtaaaacgccgaacggagttagggaaacgtaggaaacgaaacaggttatacggttaggtacgtcgttgtagggaacgggtccgattaccgaacctacgtacctaccgaaggtaaacgaaccgaaaccgaccgaaaacgtaaacctacgtaacctaggttaaccncgtaacganaaggtatacgtaagcaaacggtccgtaagacgggtaagggaccggaacgggaacctacgggtccgttaaggttacttaacgtttaggtggtttaacgggaacggttaacggggtaaagttttaacgttttacgttacgtaggttaacgttacggttaagggttttaccggttaaccgtttacccttaaccgg

SEQ ID NO: 106664 - DNA, 914 bp, Homo sapiens
  misc_feature: GYAE6OF02IJHGP.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaattgggctgagcttgggttttccttgttgcttaattttagaaggtgtccagtgtgaggtgcagtctggacggagtcgtggaggagtacgtttcggtcccgacggggtccccgggggggttccctaggacggtaccttcctccgtggacctaagttacgtcctacaagttattttatcgtttacgtaatttaatttagttggtatcggtacgtcgtacgggtcccgtcccggacggtcgtacccggaagggggtaacgggggtcggttaggggtacgggttggggtaccggaccgtaaacgtaaacgtaaaacgaccgtaaacggtagttaacgggaacggtagaaacgtaaaccgtaagttagtacgggttacgggtacggttacggttacgggtaagggtaaccggggtccctaacgttacccaaaccgtccgttaacccgtaccgaaaggtaacccgtaaaacgaaccccgaaaccggaaaacgttaaaccctcttaaacgtttcggtaaacctcgtaaccggtaactaaggaaccgtttcggaaacggtccctaacggggcccgttaagggaacggggtaccggaaccgggtaacgggaccctaaccggggtactttaaccgttaagtttaacccgttccgggtgggtttaacccggtaaacggggttaaaccggttttagggttttaaaacccccctttttagggaacccggtttttataaaacccgggttttttacgggtaaccgggtttttaacccgggtttaccccctacccccggtttaagg

SEQ ID NO: 106665 - DNA, 661 bp, Homo sapiens
  misc_feature: GYAE6OF02JMBRT.13.71.G05.1.454.CMB.1.raw
  modified_base (233)..(233): a, c, t, g, unknown or other
  misc_feature (233)..(233): n is a, c, g, or t
  modified_base (382)..(382): a, c, t, g, unknown or other
  misc_feature (382)..(382): n is a, c, g, or t
  modified_base (560)..(560): a, c, t, g, unknown or other
  misc_feature (560)..(560): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaatggggctgagctgggttttccttgttgctattttagaacggtgtccagtgtgaggtgcgagctggtggagtcgtggggggggcttgggtccagccgtgggggtcccgngagacctcgtcctgtcgcacgcctctggattctacgttttagtaggtagtttggacgtgggttggtccgcagactccagagaacgggacgtgaggtgggtcggaccaatacgtaaaggaagagtacgggagtaggaaagtacgacttanggttaggactcttgggtacggaacggggtccgtaattcccgaactaaccggttctaccgaacgtaagaacccgtaaccggcccaaaaggtaaccgttaacacgttacgtaagtcccgttggactcggaaagtcgaaaccctaggacctaggacgtacggacggaggacgttaccgggnttcggtatactttgtcgtgcganaacggnggtggaccaggttactacggttttagtaggtacgggtacgtacgggtacgggttacccggaagggtacccgg

SEQ ID NO: 106666 - DNA, 746 bp, Homo sapiens
  misc_feature: GYAE6OF02G1C03.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggaattggggctgagctgggtttccttgttgctattttagaaggtgtccagtgtgaggtgcagctggtggagtcggtggggggggcttggtccagccgtgggggtccctgacgactctcctgtgcagcctcgtggattctacttttagtaggtattgggagttggggttgggtcccgtaccgaagtaccttccgaaggaaggaaaggggtacgttggggaggttggggtcggacccgaaacgaagttaaaagggaagtaaggtagggaaagtaggaaaagtatacgtagtggtaggtacctcggtagtaggaacgggtcgtacttaccgacctactccgtaccgaaggtaacgaaccgaaacccggaccgaaaacgaacctaaccgacgttacgtacgtcgtacgacgaacgtacgtaccgaaccgacgcccgtagaggtacggtacggaacgggtacgtaacgggttacggttggttaacgttacgttttaggttacggtagaccgggtaaggtaggtacggggtcggggaccgtaacggttaacgtttaacgtttttagggaacggttcgggttaccggttaccggggtaccggggtaccgggtaacggggtaccccccgggg

SEQ ID NO: 106667 - DNA, 725 bp, Homo sapiens
  misc_feature: GYAE6OF02FUP5P.13.71.G05.1.454.CMB.1.raw
  modified_base (154)..(154): a, c, t, g, unknown or other
  misc_feature (154)..(154): n is a, c, g, or t
tcagtcacgtactacacgaccggtgctcgatttagtgtcgtcgcaagagagagggggggggtgcctcagccatggcatggatccctctcttcctcggcgtccttgcttactgcacaggatccgtggcctcctatgagctgactcagccaccctnagtgtccgtcgtccccaggacagacagccagcatcacctgctcgtggagtattaaagttgggggaataacgtatcgtacttgccgttaggttacttacgaggtacgaacggtacgacccgtacgggccctaacgttcccccgtgtacgtcgttcggtactactctacgtacaacgactaaccgacgccggtccctacggaacgggaccttcccggtaggacgtcgtaactttcgtaccgttcgtaccgttaccgtaacgtccgtacgggaaacctaccgaaccgtacctaacgttaccgaccgtaacgtacgtacgaaccggtacccgggaacccgtacggacgttggtacggcgttacgggaccgttcgtacgttaacgttacttaccggcggttacggacgggttcggaacggtaccacgtaccgagccttaccggaccgtccgtaccgtacgggtaccgacgggtactacggttccgacggttcgacgacgtacccggccaaccggtcccaacccgtgttacgtaccttccgttaccggtacccgtccccttcgtaccgttaaccggg

SEQ ID NO: 106668 - DNA, 650 bp, Homo sapiens
  misc_feature: GYAE6OF02IXGF9.13.71.G05.1.454.CMB.1.raw
  modified_base (185)..(185): a, c, t, g, unknown or other
  misc_feature (185)..(185): n is a, c, g, or t
  modified_base (288)..(288): a, c, t, g, unknown or other
  misc_feature (288)..(288): n is a, c, g, or t
  modified_base (354)..(354): a, c, t, g, unknown or other
  misc_feature (354)..(354): n is a, c, g, or t
  modified_base (492)..(492): a, c, t, g, unknown or other
  misc_feature (492)..(492): n is a, c, g, or t
tcagtcacgtactacacgaccggtgctcgatttagtgtcgtcgcaagagagagggggggggtgcctcagccatggcatggatccctctcttcctcggcgtccttgcttactgcacaggactccgtggcctcctatgagctgactcacgcccaccctgagtggtccgtcgtccccgaggacagacngccagcactcacctgctctgagaattaagttgggaataagtatgtcttgcgttggtatacgagacaagacgccgacgtaccacgtccctgtcgcgtggtactntacgtataccaatacgaacctacggccgtccgagacggtcgtccgtgacgtcgttaactttccgtntacggtccctaccgtaacgttcgtacgggaaccacgtccacctactccgactacacgtcgacggccggaccgcgagtcgaggactcggacgtacgtacgtacgttacttacgtggtacgaggtcggacgtcgacgacncgctaccgtcgttacccgttacgtacgtacggtaacccgtacgtaacgtccgaacgtttccgaccggaccgtaccgacccggaaccgaacccctacccgtaccgtaaccgttccaacccgtttccgtacccggttacccctaccgtacccgttaccgg

SEQ ID NO: 106669 - DNA, 802 bp, Homo sapiens
  misc_feature: GYAE6OF02GLKA0.13.71.G05.1.454.CMB.1.raw
tcagtcacgtactacacgaccggtgctcgatttagtgtcgtcgcaagagagaggagccttagccctggactccaaggcctttccacttggtgatcagcactgagcacagaggactcaccatggaattgggctgagcgtgggttttccttgttgctattttaagaaggtgtccagtgtgaggtgcagctggtggagtcgtggggggggcttggtccagccgtgggggtccctgagactctcctgtgcacgcctcgtggacttctacgttttagtaggttacttggagttgggttacgggtccccgtacaaggaccttccgaggaaggaacgggggacgtgggaaggtggggttcggacccaaacgaaacgttaaaaagggaagtaaggttagggaaaacggttaggaaaaacggtacgtaaaccgttagttacgggtacggggtaaccttacgttagggtttaacggggaaaacgggggtaccccgttaaagttttacccaaccgtaacctttcccgtaaccctaagggaaccgaaacccgaaacccggacccgaaaaacggtaaacccgttccgaaacgttcgttaacgttccttacggaccaaaggttaactaacccggaaccacgttacccgtgtaacgggacgttacccgggaagggtaaccgtcgggatttagggttgtttaactttaggtgtacggtcgaggtagggtgtacgggggacctaccggtaaagtttccggttttagttaacgggaggtttcggtaaccgggtcggggacccggaggggttacccccggg

SEQ ID NO: 106670 - DNA, 825 bp, Homo sapiens
  misc_feature: GYAE6OF02HBS7F.13.71.G05.1.454.CMB.1.raw
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
  modified_base (338)..(338): a, c, t, g, unknown or other
  misc_feature (338)..(338): n is a, c, g, or t
  modified_base (709)..(709): a, c, t, g, unknown or other
  misc_feature (709)..(709): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattcggggctgagtcgttgggttttccttagttgcttattttaggaaggttcgtccagtgtgaggtgcacgcgttggtcggtagtcgtgggaggaggtcttaggactaccgngtcccggttacggggggtcccctggtacgacttcctccgttggtcgccncgtccttcggttcgggttaccctaccggtacacgtccaaccgaccttacgacngggtactcgggtccgggtacccgccgacgggtcctaccgggaacgggggaagggtccgtgggtacggtcgttccgttcgttttacctttttaggtttaacgtaggttaggttacgttaacgtaccttagtacccgttccgacgtaccggtaccgttcggagggtacccggtctaacgttcccaacccgttgtacccctacggaaacgacggtaacctaaacccgtttacgggaaaacctaacgttacccggttaaccttttccggttttaaaccctacgtaaaattacccgggtaactacccggttaccgtaagccgtacgtaacgagtaacccggtacgaacccggttggtttaacttacgtttaccggngttaccggacggaggtaaaccggtggtccccggggtaaattacccggtaaacgttaacctaccggtgtaaggtacccggttaacccggtcgggaaaccgggggcctaaacccgggg

SEQ ID NO: 106671 - DNA, 658 bp, Homo sapiens
  misc_feature: GYAE6OF02IPHN2.13.71.G05.1.454.CMB.1.raw
  modified_base (402)..(402): a, c, t, g, unknown or other
  misc_feature (402)..(402): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (468)..(468): a, c, t, g, unknown or other
  misc_feature (468)..(468): n is a, c, g, or t
  modified_base (517)..(517): a, c, t, g, unknown or other
  misc_feature (517)..(517): n is a, c, g, or t
  modified_base (551)..(551): a, c, t, g, unknown or other
  misc_feature (551)..(551): n is a, c, g, or t
  modified_base (570)..(570): a, c, t, g, unknown or other
  misc_feature (570)..(570): n is a, c, g, or t
  modified_base (598)..(598): a, c, t, g, unknown or other
  misc_feature (598)..(598): n is a, c, g, or t
  modified_base (649)..(649): a, c, t, g, unknown or other
  misc_feature (649)..(649): n is a, c, g, or t
tcagtcacgtactacacgaccggtgctcgatttagtgtcgtcgcaagagagaggagccttagccctggactccaaggcctttccacttgggtgagtcagcactgagcacagaggactcaccataggaacttggggctagagcgtgggttttacctgttgcttattttagaaggtgtccagtgtgaggtgcagcgtggtggagtcggtggggggggtctttggccaggtccgtggggggtccctgagacctcctcctagtcgcagccctagtggtacttccgtaagtttttaggtaaggttcttagggtagttcggggttggtaccccggcaggtaccttccgaaggacggaaagggtcgtggggtaggttgggtacggacccaaaggttaataaaagggaanaggttaggaagttaccgaaagtactatagtagnggttacncgtgtaggaacggcctataccgaacncttcccacagtacaactaccggaacaaacgtactacaagttcgtatcgngacaggtactacggaaccttccgacgtaggacgnggtacgaggtaacgtccgngttaggtattacttagttgcgcgggtanagtaggtgaaccgattcgttaggtttacagggttacgttgaggtccggganaggggtccc

SEQ ID NO: 106672 - DNA, 870 bp, Homo sapiens
  misc_feature: GYAE6OF02G2DAP.13.71.G05.1.454.CMB.1.raw
tcagtcacgtactacacgaccggtgctcgatttagtgtcgtcgcaagagagaggagccttagccctggactccaaggcctttccacttggtgatcagcactgagtacagaggactcaccatggaattgggctgagcgtgggttttccttgttgcttattttagaaggtgtccagtgtgaggtgcatgtggtggagtcgtgggggaggcgtttagggtaaacggcccggggggtcccttcggacctcgtcctgtcgcacgcctcgtaggaactacgtactttacgagttggaccgtccgtaggatacggaacgtcggggtccgacccgtaggccgtacccggaagggggaacgggggtaccgtaggggtaacggttagggtaacggtttacggggtaaccgttaaaaggtttaaaaaaacggttaggtaacggtacccgtttaggtaacggttacgggggttaggggaaaacccgtaaaacggtaacggtaaaccggtaaccggtacgttacggaacccgtaaaccccggttagggaaacgggaccgtaaggtaacttaccgaaacccgtactaccgtaccgaacggaagtacgtagtaagttaacgtaaacggtaaacgaacgtagttagtttaccgtaacgtaacgtaaaacgttacaaaccggtaccgtaaccttacgggaccgttaccgggaacccggggacctaaccggtccgtaccggttaagttaaccgtttaacgtcggtaccgtacgaccgtagaccggtaacgtaacggttaccctaccggtaccttaacggttaacttttttacggtttttttacggtacccgttttacgggtacccggggttacccggtaaacccgggg

SEQ ID NO: 106673 - DNA, 779 bp, Homo sapiens
  misc_feature: GYAE6OF02IN20G.13.71.G05.1.454.CMB.1.raw
  modified_base (137)..(137): a, c, t, g, unknown or other
  misc_feature (137)..(137): n is a, c, g, or t
  modified_base (394)..(394): a, c, t, g, unknown or other
  misc_feature (394)..(394): n is a, c, g, or t
  modified_base (471)..(471): a, c, t, g, unknown or other
  misc_feature (471)..(471): n is a, c, g, or t
  modified_base (482)..(482): a, c, t, g, unknown or other
  misc_feature (482)..(482): n is a, c, g, or t
tcagtcacgtactacacgaccggtgctcgatttagtgtcgtcgcaagagagagggggggggtcaaccgccatccttgccctcctcctggctgttctccaaggagtctgtgccgaggtgcagctggtgcagtctggancagaggtagaaaacgcccggggagtctctgaagatctcctggttaagggttttaggaaacagtctttatcagccacgtggacgttcggcgtgggtgccgcagtagtacgggacccgggaaacggccgtagggaggtagggagtggggatcacttcgtacgtccgtggtcgtacttcgtcgaactaccagtacgtacacggtccccgttaccttaccgaacgggccacggtcctaccactcctacgaccgaccgtaanaaccgtcaactcgaccgaccctacccgcctttactcggacgacggtggacgctacgcgtaggacggtcccgcgaccnccgtctagttntacttacgtcgagaacctaaggtacaccgttaataaccggttaaacgtctttacccggaccgtttacttaaaccgtcgtaaaccggtaagggtttacgtacccggggacgttttccgggggaaccggggaacccggtaaacgggaaccccgttaccggtaccggttaccccttaccgttacccgtcccggaaccgtccccccggttaacccgaacccggggtaacccggttcccccgtttacggtttccccgggttccccccttttaccccggcggggttaaccccccctttccccg

SEQ ID NO: 106674 - DNA, 636 bp, Homo sapiens
  misc_feature: GYAE6OF02GFJHA.13.71.G05.1.454.CMB.1.raw
  modified_base (280)..(280): a, c, t, g, unknown or other
  misc_feature (280)..(280): n is a, c, g, or t
  modified_base (463)..(463): a, c, t, g, unknown or other
  misc_feature (463)..(463): n is a, c, g, or t
tcagtcacgtactacacgaccggtgctcgatttagtgtcgtcgcaagagagaggagccttagccctggactccaaggcctttccacttggtgatcagcactgagcacagaggactcacatggcattgggctgaactgggttttcctgttgctattttagaaggtgtcagtgtgaggtgcaacgtggtggagtcgtggaggagcttgatccgagccggtcgggggtcctggacgctcctccgtgtgcagcctcgtcggtccacgtcagtccactacctacntcgagtccgtcgggtacccgcgacgggtccgaccggtaggggaacgggtcgtagggacgtcgtcgttctttacttttagtagttaggtacggtgttaacgactacgtacctcgacacgtcgtcggtggaccgggcgtactccaccgtactcaccgagaaacgtaccaacttaccgaagtaccncgtacttgttactacaacgttagaacgtacgcgtagcgaccgccgtaagccgtacacggtacgttagttacttccgtaggtcgaacggagtacggtccggaccgggtacccggaataaccggttcgaacggtcgtacggtaccggtgtaacggtccgggaccgacggtaccgg

SEQ ID NO: 106675 - DNA, 880 bp, Homo sapiens
  misc_feature: GYAE6OF02I4X1F.13.71.G05.1.454.CMB.1.raw
  modified_base (770)..(770): a, c, t, g, unknown or other
  misc_feature (770)..(770): n is a, c, g, or t
tcagtcacgtactacacgaccggtgctcgatttagtgtcgtcgcaagagagaggagccttagccctggactccaaggcctttccacttggtgatcagcactgagcacagaggactcaccatggaattgggctgagctggttttcctgttgctatttagagtgtccagtgtgaggtgcagctggtggagtcgtgggggggtcttggtccagccgtcgggggtccctgacgtactctcctgtcgcagcctgtggattccgtacgttttaggtaaggttacgttcggtagttggggtttcgggtccccgtaccgtaagtaaccgttcccggagaaacgggtaacgggggtaaccgtttggggaacggtttgggggggtaccgggaccctaaaaggttaaaccgttaaaaagggggaaacgtaaggttacgggaaacggtaaggtaaaaacggtcgttaaaccgtttaggttacggtagggttaaacccttcgggttaaggttacggggaaccggggttcccgaaacgttttaccccgacccgtaacgttaccttacccgggaaagaaccggtaccgaaaacccggtaccggtaaaacggttaaacgtttcccaaaacggtttcgggaaactccgtaagggacccgtaaggtaaaccgtaccgtaaccgttacgaccccgttaaggaacgggtacggtaacggggaccggttaaacgtcccggggtacgtttacgttaagtttagttacggtttaagtccggagggtaacgggnggtaaccggtggggtaccgtaacgggttaacgtttacgttttagggtaacggggttcgtttaaccgggaaccgggttaccggggtaccggtaggggttaacccccccggg

SEQ ID NO: 106676 - DNA, 510 bp, Homo sapiens
  misc_feature: GYAE6OF01CPMZ9.48.71.G05.1.454.CMB.1.raw
  modified_base (388)..(388): a, c, t, g, unknown or other
  misc_feature (388)..(388): n is a, c, g, or t
  modified_base (414)..(414): a, c, t, g, unknown or other
  misc_feature (414)..(414): n is a, c, g, or t
  modified_base (499)..(499): a, c, t, g, unknown or other
  misc_feature (499)..(499): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcacagactggancctgatgattttgctagttgttttcngtcagcagtatggaagttcaccgtcggacagttcggccgaggggaccaaggtgaaatcaaacgatgtgctgcaccatctgtcttnctcttccgacc

SEQ ID NO: 106677 - DNA, 540 bp, Homo sapiens
  misc_feature: GYAE6OF01A4R4A.48.71.G05.1.454.CMB.1.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
  modified_base (528)..(528): a, c, t, g, unknown or other
  misc_feature (528)..(528): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctccaggctcctcatctatggtgcgtccaccgagggccactggcatcccagacaggttcagtggcagtgggtctgggacagacttcactctcaccatcaccagactggancctgatgattttgctagttgttttctgtcagtcagttagtggaacgtttcaccgtcggactagtttccggccgaaggggacctaagggtggaaactacgaaacggtaactggtacggctggaccacgatctgttcttnacttctccgtcg

SEQ ID NO: 106678 - DNA, 533 bp, Homo sapiens
  misc_feature: GYAE6OF01DNZ4L.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggtcagtgcagtgggtctgggacagacttcactctcaccatccaccagactggacgcctgatgtattttgctagttgtttttctgtcagctagttatggtaagttcaccgtcggactgttccggccgaggggaccaaggtagaaatacgaaacgtacgtggtggctgccacctatcctgtcttcacttccttcccgtacc

SEQ ID NO: 106679 - DNA, 586 bp, Homo sapiens
  misc_feature: GYAE6OF01DWMJV.48.71.G05.1.454.CMB.1.raw
  modified_base (201)..(201): a, c, t, g, unknown or other
  misc_feature (201)..(201): n is a, c, g, or t
  modified_base (392)..(392): a, c, t, g, unknown or other
  misc_feature (392)..(392): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactccttagcctggtaccagacaaaaacctggccagcctcccaggctcctcatctatggtgccgtccaccgagggccactggcactcccagacaggttcagtggcagtgggtctgggacagacttcactctcaccatcaccagactggancctgatgtattttgctagttgtttttctgttcagtctagttagtggtaagtttcaccgtcggtactagttccggaccgtaggggaacctaagggtaggtaaaactacgaaaaccggtaacgttcgggtacggtaccttaggaccaacccgtattaccgttcgttacctttacaacttcccgtttccccggaccc

SEQ ID NO: 106680 - DNA, 540 bp, Homo sapiens
  misc_feature: GYAE6OF01DSWAK.48.71.G05.1.454.CMB.1.raw
  modified_base (203)..(203): a, c, t, g, unknown or other
  misc_feature (203)..(203): n is a, c, g, or t
  modified_base (422)..(422): a, c, t, g, unknown or other
  misc_feature (422)..(422): n is a, c, g, or t
  modified_base (526)..(526): a, c, t, g, unknown or other
  misc_feature (526)..(526): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaaacctggccagcctcccaggctcctcatctatggtgcgtccaccagggccactggcactcccagacaggttcagtggcaggtgggtctgggacagacttcactctcaccatcaccagactggacgcctgatgtattttgctagttgtttttcngttcagctagtatggtaattcacctcggactagttccggaccgaggggaccaagggtaggaaactcgaaaacgtaatggtcggctggcacctatcgtgtcttanacttcctcccgtac

SEQ ID NO: 106681 - DNA, 588 bp, Homo sapiens
  misc_feature: GYAE6OF01CO4OF.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctccaggctcctcatctatggtgcgtccaccacgggccactggcatccccagacaggttcagtggcaggtgggtctgggacagacttcgactctcaccatcaccagactggacgcctgatgtattttgctagtttgttttctgtacagctagttagtaggtaacgttcaccgttcggaaccttacgttccgggaccgaaggggtaacccgtaagggtacggaaaataccgaaaacggtacgtagggtacggacgtacggcctaccctagttccttacgttaccttactaccttccgttccccgtaccg

SEQ ID NO: 106682 - DNA, 512 bp, Homo sapiens
  misc_feature: GYAE6OF01AFOYT.48.71.G05.1.454.CMB.1.raw
  modified_base (202)..(202): a, c, t, g, unknown or other
  misc_feature (202)..(202): n is a, c, g, or t
  modified_base (489)..(489): a, c, t, g, unknown or other
  misc_feature (489)..(489): n is a, c, g, or t
  modified_base (503)..(503): a, c, t, g, unknown or other
  misc_feature (503)..(503): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgtattttgctagttgttttctgtcagtcagtatggtaagttcacctcggactagttcggccaggggaccaaggtgaaatcgaaacgactgtggntgcacatctgtctnactctccgc

SEQ ID NO: 106683 - DNA, 515 bp, Homo sapiens
  misc_feature: GYAE6OF01BJ6HZ.48.71.G05.1.454.CMB.1.raw
  modified_base (203)..(203): a, c, t, g, unknown or other
  misc_feature (203)..(203): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatccaccagactggagcctgatgtattttgctagttgttttctgttcagtctagtatggtaagttcacctcggactagttcggccgaggggaccaagggtgaaatcaaacgactgtgntgcacntctgtctnctctccgc

SEQ ID NO: 106684 - DNA, 588 bp, Homo sapiens
  misc_feature: GYAE6OF01DLAHM.48.71.G05.1.454.CMB.1.raw
  modified_base (293)..(293): a, c, t, g, unknown or other
  misc_feature (293)..(293): n is a, c, g, or t
  modified_base (414)..(414): a, c, t, g, unknown or other
  misc_feature (414)..(414): n is a, c, g, or t
  modified_base (549)..(549): a, c, t, g, unknown or other
  misc_feature (549)..(549): n is a, c, g, or t
  modified_base (567)..(567): a, c, t, g, unknown or other
  misc_feature (567)..(567): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctccncatctatggtgcgtccaccagggcccactggcatcccagacaggttcagtgcagtgggtctgggacagacttcactctcaccatcacagactggacgcctgatgtattttcgactagtttnttttcgtgtctagctagttagtagggtaacttcaaccgttcggaacttacggttccggaccggtaacggggaaccgtaagggttaggaaaactacgaaaaccggtaacgtggtacgggtactcggaccaaccgtnttacgttcgttaccttanaaccttcccttccccggtacc

SEQ ID NO: 106685 - DNA, 565 bp, Homo sapiens
  misc_feature: GYAE6OF01BL1R0.48.71.G05.1.454.CMB.1.raw
  modified_base (202)..(202): a, c, t, g, unknown or other
  misc_feature (202)..(202): n is a, c, g, or t
  modified_base (417)..(417): a, c, t, g, unknown or other
  misc_feature (417)..(417): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgtattttgctagttgtttttcngtcagctagtatggtaacttcaccgtcggactagttccggaccgtaggggaaccaagggtacggaaaattacgaaaaccggtaactggtacggacttaggaccaaccgtagttccttacggttctttacacttcccgttcccgtaccc

SEQ ID NO: 106686 - DNA, 525 bp, Homo sapiens
  misc_feature: GYAE6OF01EBMOH.48.71.G05.1.454.CMB.1.raw
  modified_base (203)..(203): a, c, t, g, unknown or other
  misc_feature (203)..(203): n is a, c, g, or t
  modified_base (388)..(388): a, c, t, g, unknown or other
  misc_feature (388)..(388): n is a, c, g, or t
  modified_base (508)..(508): a, c, t, g, unknown or other
  misc_feature (508)..(508): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctgccagcctcccagctcctcatctatggtgcgtccaccagggccactggcatcccagacaggttcagtggcagtgggtctgggacagacttcactctcaccatcaccagactggancctgatgtattttgctagttgtttttctgtcagtcagttatggtaagttcacctcggactagttccggccgtaggggaccaagggtggaaatcgaaacgaactgtggactgccacatctntcttcattcctcccgtc

SEQ ID NO: 106687 - DNA, 513 bp, Homo sapiens
  misc_feature: GYAE6OF01AU87C.48.71.G05.1.454.CMB.1.raw
  modified_base (203)..(203): a, c, t, g, unknown or other
  misc_feature (203)..(203): n is a, c, g, or t
  modified_base (415)..(415): a, c, t, g, unknown or other
  misc_feature (415)..(415): n is a, c, g, or t
  modified_base (503)..(503): a, c, t, g, unknown or other
  misc_feature (503)..(503): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtggtctgggacagacttcactctcaccatcaccagactggagcctgatgattttgctagttgttttcngtcagcagtatggaagttcacctcggacagttccggccaggggaccaagggtggaaatcgaaacgactgtggctgcacatctgtcttnatcttcccgc

SEQ ID NO: 106688 - DNA, 516 bp, Homo sapiens
  misc_feature: GYAE6OF01CUJTT.48.71.G05.1.454.CMB.1.raw
  modified_base (482)..(482): a, c, t, g, unknown or other
  misc_feature (482)..(482): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggcccactggcatccccagacaggttcagtggcagtgggtctgggacagacttcactctcaccatcagcagcctgcagtctgaagtattttacattttattactgtcagcagtatcgtaagtgactccgacgtttggccaagggaccaaggtggaagtcaaacgactgnggctgcaccatctgtcttcattccttcccgctac

SEQ ID NO: 106689 - DNA, 603 bp, Homo sapiens
  misc_feature: GYAE6OF01C7S19.48.71.G05.1.454.CMB.1.raw
  modified_base (203)..(203): a, c, t, g, unknown or other
  misc_feature (203)..(203): n is a, c, g, or t
  modified_base (382)..(382): a, c, t, g, unknown or other
  misc_feature (382)..(382): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaacctggccagcctcccaggcctcctcatctatggtgccgtccaccgagggcccacgtggcactccccagacaggttcaggtggcaggtgggtcgtgggacagtacttcactcncaccatccaccagactggactcctagatgtattttgacttagtttgtttttctgttcagtctagttagtaggtaacgtttccaaccgttcggactacggttccgggaccgtaacgggggaacctaagggtacggaaacgtaccgaaaacggtaacgttaggtcggtacgtacggccaaccgtattccgttacgttacttactacttcccgttccccgtacc

SEQ ID NO: 106690 - DNA, 519 bp, Homo sapiens
  misc_feature: GYAE6OF01BDX14.48.71.G05.1.454.CMB.1.raw
  modified_base (202)..(202): a, c, t, g, unknown or other
  misc_feature (202)..(202): n is a, c, g, or t
  modified_base (509)..(509): a, c, t, g, unknown or other
  misc_feature (509)..(509): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcacatcaccagactggagcctgatgattttgcagttgttttctgtcagcagtatggaagttcaacctcggactagttcggacctaggggaacccaagggtggaaaatcaaaacgaactgtggctggcacatctgtacttnactcttccgc

SEQ ID NO: 106691 - DNA, 580 bp, Homo sapiens
  misc_feature: GYAE6OF01CT7JJ.48.71.G05.1.454.CMB.1.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagaatgttaagagccactccttagcctggtaccagcaaaaacctggccagcctccaggctcctcatctatggtgcgtccaccagggccactggcatcccagacaggttcagtggcagtgggtctggggacagacttcactctcaccatcaccagactggacncctgatgtattttgctagttgttttctgtcagctagtatggtaattcaacctcggactacgttccggaccgaagggggtaacccaagggtacggaaatacgaaaaaccggtaacgtggtacgggacttacggcctaacccgtagttaccgttacggttccctttacacgtttcccgttcccccggtaccc

SEQ ID NO: 106692 - DNA, 520 bp, Homo sapiens
  misc_feature: GYAE6OF01CMMI0.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccataaccagactggacgcctgatgattttgctagttgttttctgtcagtcagtatggaagttcactcggactagttcggccgaggggaccaagggtcgaaatcgaaacgactgtgctgcacatctgtcttcattccttccgctacg

SEQ ID NO: 106693 - DNA, 592 bp, Homo sapiens
  misc_feature: GYAE6OF01D9T4J.48.71.G05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (425)..(425): a, c, t, g, unknown or other
  misc_feature (425)..(425): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaancgccaccctntcctgtagggccagtcagaatgttaagngccactccttagcctggtaccagcaaaaacctggccagcctccaggctcctcatctatggtgcgtccacaggccactggcatcccagacaggttcagtggctaggtgggtcgtgggacaggacttcgactctccaccatccaccagactggacgcctgactgtattttcgctaggtttgtttttcngttcagtcgtagttagtggtaacgttcaaccgttcggactacgttcggccgtaacggggaccgtaagggtacggtaaactacgaaaacggtaaccgttgggtcggtactaggacccgtaacccgtattccgttacgttaccttaccgtacttcccgttccccgtacc

SEQ ID NO: 106694 - DNA, 541 bp, Homo sapiens
  misc_feature: GYAE6OF01EUT7G.48.71.G05.1.454.CMB.1.raw
  modified_base (203)..(203): a, c, t, g, unknown or other
  misc_feature (203)..(203): n is a, c, g, or t
  modified_base (392)..(392): a, c, t, g, unknown or other
  misc_feature (392)..(392): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctggggacagacttcactctcaccatcaccagactggacncctgatgattttgctagttgttttctgttcagtcagtatggtaagttcaccgttcggacagttccggacctaggggaccaagggtggaaactcgaaaacgaacgtggtggactggccacctatcgtcgtcttacattccgttcccgtac

SEQ ID NO: 106695 - DNA, 544 bp, Homo sapiens
  misc_feature: GYAE6OF01DHY4H.48.71.G05.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagaatgttaaganccactccttagcctggtaccagcaaaaacctggccagccctcccaggctcctcatctatggtncgtccaccagggcccactggcatcccagacaggttcagtgcagtggtctggacagacttcactctcacatcacagactggacgtcctgatgattttgctagttgtttttcngtcagctagtntgtaagttcacctggactgttcggacgtagggaccagggtagaaactacgaaacgacgttggtacggcttacggacaacccgtataccgttgttacttctaacttccgtttccccgacc

SEQ ID NO: 106696 - DNA, 533 bp, Homo sapiens
  misc_feature: GYAE6OF01AJ909.48.71.G05.1.454.CMB.1.raw
  modified_base (418)..(418): a, c, t, g, unknown or other
  misc_feature (418)..(418): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggcctcctcatctatggtgcgtccaccacggccactggcatcccagacaggttcagtggcaggtgggtctgggacagacttcactctcaccatcaccagactggagcctgatgtatttgctagttgttttcngtcagcagtatggaattcaccgtcggtacagttcggaccgaggggtaccaagggtgaaatcgaaacgtactggtcggctgccaccgattcgtnttccttancttccgttcccgac

SEQ ID NO: 106697 - DNA, 528 bp, Homo sapiens
  misc_feature: GYAE6OF01AF1LR.48.71.G05.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
  modified_base (518)..(518): a, c, t, g, unknown or other
  misc_feature (518)..(518): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggancctgatgtatttgctagttgttttctgttcagtctagttatggtaagttcaccgtcggactacgttcggccgtaggggaccaagggtagaaatcgaaacgtaactggtggctgcactatctcgtcttanctcctccgcc

SEQ ID NO: 106698 - DNA, 641 bp, Homo sapiens
  misc_feature: GYAE6OF01DJYPJ.48.71.G05.1.454.CMB.1.raw
  modified_base (439)..(439): a, c, t, g, unknown or other
  misc_feature (439)..(439): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgagggaaagcgccaccctctcctgtaggccagtcagaatgttaagagccactccttagcctggtaccagacaaaacctggccagcctccaggctcctcatctatggtgccgtccaccgagggcccacgtggccactcccagacgaggttcagtgcaggtgggtcgtgggacagtacttcactctccaccatccaccagtacgtggacgtcctgattgtagtttttcgcgtagtttcgtttttcgngttcagtctagttataggtaacgttccaacccgtcgggtaacctaggttaccggaccggtaacgggtaacccgtaaggggttaacggaaaaccgttaacgaaaaaccggttaacgtgggtacggtaccgtacggtaccctaaccgttaacttccgttacggtttacctttaccgtacctttccccgtttacccccgtacccg

SEQ ID NO: 106699 - DNA, 524 bp, Homo sapiens
  misc_feature: GYAE6OF01BZ3I2.48.71.G05.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaanccgccaccctctcctgtaggccagtcagaatgttaagngccactccttagcctggtaccagcaaaactgcagcctccaggctctcattatgatacatccaccacggccactggtctcccagccaggttcactgggcggtggtcgtgggacagagttcactctcaccatcagcagcctgcagtctgaagtattttacattttatacttgtcagcagtatagtaagtggactcgtacgtttggacccgtaagggaccaagggtgaagtacgaaacgtaagtgnggctgcaacntcgtagtcttacattcctcccgctactctag

SEQ ID NO: 106700 - DNA, 578 bp, Homo sapiens
  misc_feature: GYAE6OF01D6ZI0.48.71.G05.1.454.CMB.1.raw
  modified_base (391)..(391): a, c, t, g, unknown or other
  misc_feature (391)..(391): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagacaaaacctggccagcctcccaggctcctcatctatggtgcgtccaccagggccactggcatcccagacaggttcagtggcaggtgggtctgggacagacttcactctcaccatcaccagactggancctgatgtattttgctagttgttttctgtcagtctagtatggtaattcaccgtcggactagttccgggaccgtaacgggggacctaagggtacggaaaacttaccgaaaacggtaacgttgggtacgggtactcggaccaaccgtagttaccgttggttaccttacactttcccgttcccccgtacc

SEQ ID NO: 106701 - DNA, 532 bp, Homo sapiens
  misc_feature: GYAE6OF01A0PDO.48.71.G05.1.454.CMB.1.raw
  modified_base (390)..(390): a, c, t, g, unknown or other
  misc_feature (390)..(390): n is a, c, g, or t
  modified_base (422)..(422): a, c, t, g, unknown or other
  misc_feature (422)..(422): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctccaggctcctcatctatggtgccgtccaccagggccactggcatcccagacaggttcagtggcagtgggtctgggacagacttcactctcaccatcaccagactggancctgatgtatttgctagttgttttctgtcagnagtatggtaacgttcaccgtcggactcgttcggccgagggacctagggtagaactcgaaacgactggtggctggaccaccgatcctgttacttcacttccgttcccgacc

SEQ ID NO: 106702 - DNA, 545 bp, Homo sapiens
  misc_feature: GYAE6OF01APAGO.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatccccagacaggttcagtggcagtgggtctgggacagacttcactctcaccatcaccagactggagcctgatgattttgctagttgttttctgttcagtcagtatggtaagttccacctcgggactagtttccgggccgagggggaccctaagggtaggaaatccgaaaacggaactggtcggctgccaccgatctgtccttacacttccgttcccgacc

SEQ ID NO: 106703 - DNA, 548 bp, Homo sapiens
  misc_feature: GYAE6OF01BYK3U.48.71.G05.1.454.CMB.1.raw
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactccttagcctggtaccagcaaaaacctggccagcctcccaggctcctcatctatggtgcgtccaccagggccactggcactcccagacaggttcagtggcagtggtctgggacagacttcgactctcaccatcaccagactggagcctgatgtattttgctagttgttttctgtcngctagtatggacttcacctcggactacgttccggaccgaacggggtaccaagggtacggaaataccgaaaacgtacgtggtcggtactcgcacctagtccttgtccttacacttccgtccccgtacc

SEQ ID NO: 106704 - DNA, 605 bp, Homo sapiens
  misc_feature: GYAE6OF01B17AC.48.71.G05.1.454.CMB.1.raw
  modified_base (292)..(292): a, c, t, g, unknown or other
  misc_feature (292)..(292): n is a, c, g, or t
  modified_base (417)..(417): a, c, t, g, unknown or other
  misc_feature (417)..(417): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagccgccaccctctcctgtagggccagtcagaatgttaagagccactccttagcctggtaccagacaaaactggccagcctccagctcctnatctatggtcgccgtccaccgacggccacgtgcactccagtacaggttcagtggcaggtggctgggacagtactcactctcacatcacagactggactctagatgtatttgactagttgttttcngtctagtcagtagtaggtaacttccgtacctacggactacgttccggacccggtaaggggaacccaaggggtaacggtaaaactaccgtaaaaacggtaaccggttagggtacggacttacggaccccaaccgttaagtttccgtacggtttacccttaccgtacttcccgtttcccccggtaacccg

SEQ ID NO: 106705 - DNA, 533 bp, Homo sapiens
  misc_feature: GYAE6OF01AG0F9.48.71.G05.1.454.CMB.1.raw
  modified_base (390)..(390): a, c, t, g, unknown or other
  misc_feature (390)..(390): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatccccagacaggttcagtggcagtgggtctgggacagacttcactctcaccatcaccagactggancctgatgtattttgctagttgttttctgttcagtcagtatggacttcaccgtcggactacgttccggccgaggggaccaagggtggaaactcgaaagccgaacgtcggtaggctgccaccatctgttcttctctccttccccg

SEQ ID NO: 106706 - DNA, 517 bp, Homo sapiens
  misc_feature: GYAE6OF01BC5GH.48.71.G05.1.454.CMB.1.raw
  modified_base (202)..(202): a, c, t, g, unknown or other
  misc_feature (202)..(202): n is a, c, g, or t
  modified_base (489)..(489): a, c, t, g, unknown or other
  misc_feature (489)..(489): n is a, c, g, or t
  modified_base (506)..(507): a, c, t, g, unknown or other
  misc_feature (506)..(507): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatccaccagactggagcctgatgtattttgctagttgttttctgtcagcagtatggaagttcacctcggactagttcggaccaggggaccaagggtgaaatcaaacgactgtggntgcaccgatctgtcttnntccttcccgc

SEQ ID NO: 106707 - DNA, 581 bp, Homo sapiens
  misc_feature: GYAE6OF01AJMZB.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctggccagcctcccaggctcctcatctatggtcgcgtccaccagggccactggcatcccagacaggttcagtggcagtgggtctgggacagacttcactctcaccatcaccagactggacgcctgactgtatttgctagtttgttttctgtcagtctagttatggtaacttcaccgtacggtactagttccgggaccgaggggaccctaagggtacgtaaacgtccgaaaacggtacgttgggtacggtacttacggcccaacccgtattcccgttacgttcctttacgctttcccgttccccggtaaccc

SEQ ID NO: 106708 - DNA, 898 bp, Homo sapiens
  misc_feature: GYAE6OF01B79JW.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagccgcccaccctctccgtgtacgggccagtcagaatgttaagcgccactcctagcctggtaccagacaaaacctggccagcctcccaggcctcctcatctagtggtcgccgtccaccgacgggcccaacgtggaccactaccccgacgaacctacgggttacaaggtcggaccgtaaggtcggggtacgtcgggggaactaacggtacctttccgaaccttcctacccaacccgtaacttacccgaaacccgaacgggtaaccgttacggggaacgtaccccgtttagggacgtttagggtttaaacgttttttcggtaaccgttaacgggtttttcggtttttttacccgttagggtttacccgttaacgggtcccgttaaagggtttaagttttaaccgggggttaaaaccgttttcccgtaaaccccggtttaccggggtaaacccgtttaaccgggttttacccgggggaacccccggtaaagggggggtaaacccccgtaaaaggggggtttaaaccgggtaaaaaccggttaaacccgaaaaaacccggggttaaaccggtttaacggggttaccggggtaaccgtttaacccgggacccgttaaaccccggttaagttttacccgttaccggtttaaccccgtttttaaccaacccgtttttaccccgtttccccccgggttaacccc

SEQ ID NO: 106709 - DNA, 533 bp, Homo sapiens
  misc_feature: GYAE6OF01BVL13.48.71.G05.1.454.CMB.1.raw
  modified_base (414)..(414): a, c, t, g, unknown or other
  misc_feature (414)..(414): n is a, c, g, or t
  modified_base (500)..(500): a, c, t, g, unknown or other
  misc_feature (500)..(500): n is a, c, g, or t
  modified_base (520)..(520): a, c, t, g, unknown or other
  misc_feature (520)..(520): n is a, c, g, or t
tcagagtatacatacacgaccggtgctcgatttagtgtcgtcgcaagagagagggggaagagctgcttcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtggtctgggacagacttcactctcaccatcaccagacctggagcctgatgatttgcagttgttttcngtcagcagtatggaagtttcacctcggacagtttccggaccgtaggggacccaagggtcggaaaattccaaaacgaacgtgtcggntggccaccatctgtcttacntccttcccggtac

SEQ ID NO: 106710 - DNA, 574 bp, Homo sapiens
  misc_feature: GYAE6OF01DXU95.48.71.G05.1.454.CMB.1.raw
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccaccctctcctgtagggccagtcagaatgttaagagccactccttagcctggtaccagacaaaacctggccagcctcccaggctcctcatctatggtgcgtccaccagggccactggcatcccagacagttcagtgcagtgggtctgggacagacttcactctcaccatcaccagactggacncctagatgtattttgctagttgtttttcngttcagtcagtagtggtaattcacctcggactagttccggaccgagggaacctagggtacggaaaactaccgaaaacggtacttagggtacggtacgtacggtaccaacccgtagttcccgttggttacctttaccaactttcccgttccccgtacc

SEQ ID NO: 106711 - DNA, 608 bp, Homo sapiens
  misc_feature: GYAE6OF01CL1T9.48.71.G05.1.454.CMB.1.raw
  modified_base (203)..(203): a, c, t, g, unknown or other
  misc_feature (203)..(203): n is a, c, g, or t
  modified_base (421)..(421): a, c, t, g, unknown or other
  misc_feature (421)..(421): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgctccaggggaaancgccacctctcctgtaggccagtcagaatgtaagagccactcttagcctggtaccagcaaaaacctggccagcctccaggctcctcatctatggtgcgtccaccacggccactggcactcccagacaggttcagtgcagtggtctgggacagaactcaactctacaccatcaacagactggacgtctgatgtaattttcgactagtttcgtttttcgngttcacgctaagttagttagggtaacgttcgtaacccgttacgggacttaaccggttccgggaccggaacggggtaaccctaaggggtaacgaaaagttacccgaaaaacgtaacgtggtacgggtctaacggcccaaaccttagttaccgtggtttaccttacgtacttcccgttccccgtaaccg

SEQ ID NO: 106712 - DNA, 621 bp, Homo sapiens
  misc_feature: GYAE6OF01EFAT7.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
  modified_base (421)..(421): a, c, t, g, unknown or other
  misc_feature (421)..(421): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccagggggaacncgccacctctccgtgtacgggccagtcagaatgtaagngccatcttagcctggtaccagcaaaacctggccaagcctcccaggctcctcatctatggtgcgtccaccnggccactggcactccagactggttcagtcgctaggngggtctgggacacgcttcactctcgaccatcaccagaactggacncctgatgtatttgcgtagtttcgttttcngttcgagtcctaggtattagggtaactttcaccggttacggtaacgtagtttaccgggacccggttaaggggaacccgtaagggttaaccggaaacgttaaccgaaaccggtaacgttcgggtacggtacccttagggaccccaaccgttacttacccgttcggttacccttaccgtacgttcccttcccccgggtaacc

SEQ ID NO: 106713 - DNA, 569 bp, Homo sapiens
  misc_feature: GYAE6OF01BPFUX.48.71.G05.1.454.CMB.1.raw
  modified_base (202)..(202): a, c, t, g, unknown or other
  misc_feature (202)..(202): n is a, c, g, or t
  modified_base (419)..(419): a, c, t, g, unknown or other
  misc_feature (419)..(419): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccacctctcctgtagggccagtcagaatgtaagagccactccttagcctggtaccagcaaaacctggccagcctccaggctcctcatctatggtgcgtccaccgagggcccactcggcactcccagacaggttcagtggcgtaggtgggtctgggacagacttcactctcacatcacagactggagcctgactgtatttgcttagttgtttttcngtcagtcagtacgtaggtacgttcgacctacggactacgttaccggaccgtaacggggacctaagggtaacggtaaactacgaaaacgtaacgtggtacgacgtacgacctactagtcgttcgtaccttactacttcccgttacccgtcc

SEQ ID NO: 106714 - DNA, 565 bp, Homo sapiens
  misc_feature: GYAE6OF01D2QUZ.48.71.G05.1.454.CMB.1.raw
  modified_base (202)..(202): a, c, t, g, unknown or other
  misc_feature (202)..(202): n is a, c, g, or t
  modified_base (424)..(424): a, c, t, g, unknown or other
  misc_feature (424)..(424): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactccttagcctggtaccagcaaaacctgccagcctccaggctcctcatctatggtgcgtccaccgacgggccactcggaccactccccgagacaggttcagtggcaggtggtctgggacagtccttcactctcaccatccacagtactggacgcctgtatgtatttgctagttgttttcngtctagtctagtagtggtattcgaccgtcggactagttccggaccgaaggggtaccctaagggtagaaactacgaaacggtaacgttggacggtactcggaccaccgtattcgttcgttcttacgccttccgtccccgtac

SEQ ID NO: 106715 - DNA, 516 bp, Homo sapiens
  misc_feature: GYAE6OF01DNR9U.48.71.G05.1.454.CMB.1.raw
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccaccctctcctgtagggccagtcagaatgttaagagccactccttagcctggtaccagcaaaaacctggccagcctccaggctcctcatctatggtgcgtccaccagggccactggcatccccagacaggttcagtggcaggtgggtctgggacagacttcactctacacatcacagactggacgcctgattcgtattttgctagtttcgttttcngttcagtctagtatggtattcacctcggactgttcggacgagggaccaaggtgaaatcaaagactgtgctgcacntctgtacttnctctccgtac

SEQ ID NO: 106716 - DNA, 575 bp, Homo sapiens
  misc_feature: GYAE6OF01D0T0Y.48.71.G05.1.454.CMB.1.raw
  modified_base (203)..(203): a, c, t, g, unknown or other
  misc_feature (203)..(203): n is a, c, g, or t
  modified_base (398)..(398): a, c, t, g, unknown or other
  misc_feature (398)..(398): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaaacctggccagcctcccaggcctcctcatctatggtcgccgtccaccgagggccactggcactcccagacaggttcagtggcagtgggtctgggacagacttcactctcaccatccaccagactggacncctagatgtattttgctagttgttttctgtcagctagttataggtaagttccaccgtcggactacgtttccgggaccgaggggaaccgtaagggtacggaaactacgaaaacggtaacgttggtcggtctagaccaaccgtattccgttcgttacttcacttcccgttccccgtacc

SEQ ID NO: 106717 - DNA, 527 bp, Homo sapiens
  misc_feature: GYAE6OF01ADENR.48.71.G05.1.454.CMB.1.raw
  modified_base (203)..(203): a, c, t, g, unknown or other
  misc_feature (203)..(203): n is a, c, g, or t
  modified_base (514)..(514): a, c, t, g, unknown or other
  misc_feature (514)..(514): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgtattttgctagttgttttctgtcagtcagtatggtagttcaccgtcggactgttccggccgtaggggaccagggtacgaaatcgaaacgactggtcggctgcactatctgtcttacncttccgtccgacc

SEQ ID NO: 106718 - DNA, 586 bp, Homo sapiens
  misc_feature: GYAE6OF01BHH7D.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccagggaaancgccaccctctcctgtagggccagtcagaatgttaagagccactccttagcctggtaccagcaaaacctggccacgcctccaggctcctcatctatggtgcgtccaccacggccactcggcactcccagacaggttcagtggccccgagtcgggtcgtgggacagtacttcgactctcaccactcaccagactggagcctgatgtatttgtctagttgttttcgttgttcgtagtctagtagttaggtacgttcgtaccgtacggtactacgttacggtaccgtacggggtaccaaggtacggaaacgtacgaaaccgaacgttacggtacggtacgtacgcgacctacgttctcgttacttactacttccgttcccgtacccg

SEQ ID NO: 106719 - DNA, 556 bp, Homo sapiens
  misc_feature: GYAE6OF01DIQLP.48.71.G05.1.454.CMB.1.raw
  modified_base (407)..(407): a, c, t, g, unknown or other
  misc_feature (407)..(407): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgctccaggggaaagcgccaccctctcctgtagggccagtcagaatgttaagagccactccttagcctggtaccagcaaaacctggccagcctcccaggctcctcatctatggtgccgtccaccagggccactggcatccagacaggttcagtggcagtggtctgggacagacttcactctcaccatcaccagactggagcctgatgatttgctagttnttttctgttcagctagtatggtaacgttcacctggactagttcggaccgtaggggaacctaagggtaggaaaactcgaaaacggtaactcggtaggcttacgggaccaccgtattacgttcggttacttcgacttccgttccccggacc

SEQ ID NO: 106720 - DNA, 573 bp, Homo sapiens
  misc_feature: GYAE6OF01DPR99.48.71.G05.1.454.CMB.1.raw
  modified_base (239)..(239): a, c, t, g, unknown or other
  misc_feature (239)..(239): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (436)..(436): a, c, t, g, unknown or other
  misc_feature (436)..(436): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaagcgccacctctcctgtagggccagtcagaatgtaagngccactccttagcctggtaccagacaaaacctggccagccctcccaggcctcctcatctatggtgccgtccaccgacgggccacgtcggcactcccagactaggttcagtggcaggtgggtctgggacagtacttcactcncacactcaccagcgtggacncctagtattgtattttcgacttagtttcgtttttcngtcagtctagttagtaggtaactttccaaccgtcggactacggttccggacggtaacggggtaaccgtagggtagaaaactacgaaacgtacgtggtcgacgtgaccactatctcgttacttctactcccgtccgac

SEQ ID NO: 106721 - DNA, 586 bp, Homo sapiens
  misc_feature: GYAE6OF01B08T3.48.71.G05.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (571)..(571): a, c, t, g, unknown or other
  misc_feature (571)..(571): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctgtacggccagtcagaatgttaagngccactccttagcctggtaccagacaaaacctggccacgcctcccaggcctcctacatctagtggtcgccgtccaccgacgggccactggcactcccagacgtaggtcagtggcaggtggtcgtgggacagtactcactctcaccatccaccgagacgtggactcctgatgtatttgcttagtttgttttctgtctagtctagttagtggtaacgttcaccgttacggactaggttccggacggtaacggggaccaagggtacgtaaacgtaccgaaaacggtacgtaggtcggtcacggaccaacgtattccgtacgttaccttacncttcccgtcccgtac

SEQ ID NO: 106722 - DNA, 574 bp, Homo sapiens
  misc_feature: GYAE6OF01DFIV8.48.71.G05.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccactctctcctgtagggccagtcagaatgttaagagccactccttagcctggtacagacaaaacctggccagcctccaggctcctnatctatggtgcgtccaccaggccactggcatcccagacaggttcagtggcaggtgggtctgggacagacttcactctcaccatcaccagactggagcctgattgtattttgctagtttgtttttctgtcagctagtatggtaagttcaccgtcggactagttccggaccgtaaggggacctaaagggtacggaaaactaccgaaaacggtaacgttggtagggcttacggacctaacccgtagttccttacggttacctttaccactttcccgttacccccg

SEQ ID NO: 106723 - DNA, 646 bp, Homo sapiens
  misc_feature: GYAE6OF01DAQNV.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggccaccctgtctttgtctccgaggggaacnccgccaccctctcctgtacgggccagtcagaatgttaagacgccactccttagcctggtaccagacaaaacctggaccagccctccgaggcctcctcactctagtggtcgccgtaccaccgacgggcccacgtggcactacccgagacgaggttacagttcggctaggtcggtcgtacgggactagtaccttcgactctaccaccactccaaccagtaccgtaggaccgtctagacgttgtattttcgacgttagtttgttttcgtgtacgagtctaagttagtacggtaacgttctaccgtcggtactacggttccggaccggagggtaaccgtaagggtacggtaaactcgaaaaccgtaacgtcggtacggtcgttacggccaaccgtacgttaccgttacgtttacccttagtacccttccccgttcccgtaaccc

SEQ ID NO: 106724 - DNA, 594 bp, Homo sapiens
  misc_feature: GYAE6OF01BPRI2.48.71.G05.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtaggccagtcagaatgttaagngccactccttagcctggtaccagacaaaaacctggccacgccctcccaggcctcctcatctatcggtgccgtccaccgacgggcccacgtcggcactcccagactaggttcaggtggcgtaggtgggtcgtgggacagtacttcactctccaccatcaccagacgtggactcctgattgtattttgcttagtttgttttctgtctagtctagttagtaggtaacgttcaccgtacggtactacgttccggaccgaacggggtaaccaagggtacggtaaactacgaaaacgtacgttggtacggtctacggaccgacctagtccgttcgttaccttacacttcccgtcccgtacg

SEQ ID NO: 106725 - DNA, 585 bp, Homo sapiens
  misc_feature: GYAE6OF01CHTI5.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatccaccagacgtggagccctgacttgtattttgctagtttgtttttctgttcagtctaggttatggtaagttcaccgttacggactacgttccgggaccgtaacgggggaacctaagggtacggaaactaccgaaaacgtaacgttcggtacggcttacggacccaccgtattccgttacgttccttactaccttcccgttccccgtacc

SEQ ID NO: 106726 - DNA, 588 bp, Homo sapiens
  misc_feature: GYAE6OF01BE68D.48.71.G05.1.454.CMB.1.raw
  modified_base (202)..(202): a, c, t, g, unknown or other
  misc_feature (202)..(202): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagaatgttaagagccactccttagcctggtaccagacaaaacctggccagcctccaggctcctcactctatggtcgcgtccaccacgggccacgtggcactcccagacaggttcagtgcagtggtctgggacagacttcactctcaccatcaccagactggancctgatgtattttgctagttgttttcngttcagtcagttagtaggtaacgttcgaccgttcggactagttccggaccgtagggggtaacccaagggtacggaaacttaccgaaaacggtaacgttgggtacggacgttacggaccaacccgtagttaccgttacgttaccgtttacaacttcccgttccccgtacccg

SEQ ID NO: 106727 - DNA, 542 bp, Homo sapiens
  misc_feature: GYAE6OF01AV4IH.48.71.G05.1.454.CMB.1.raw
  modified_base (203)..(203): a, c, t, g, unknown or other
  misc_feature (203)..(203): n is a, c, g, or t
  modified_base (526)..(526): a, c, t, g, unknown or other
  misc_feature (526)..(526): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgtattttgctagttgttttctgtcagtcagtatggtaagttcgaccgtcggactagttcggaccgaggggtaccaagggtaggaaatcgaaaacgacgtggtcggacttcgcaccagttcctggtcttanacttccttcccgtacc

SEQ ID NO: 106728 - DNA, 626 bp, Homo sapiens
  misc_feature: GYAE6OF01C4EYZ.48.71.G05.1.454.CMB.1.raw
  modified_base (201)..(201): a, c, t, g, unknown or other
  misc_feature (201)..(201): n is a, c, g, or t
  modified_base (588)..(588): a, c, t, g, unknown or other
  misc_feature (588)..(588): n is a, c, g, or t
  modified_base (596)..(596): a, c, t, g, unknown or other
  misc_feature (596)..(596): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctcaggcaccctgtctttgctccgaggggaancgccaccctctccgtgtacgggccagtcagaatgtaagagccactccttagcctaggtaccagacaaaacctggccacgcctccaggtcctcctcatctatcggtcgccgtacccaccgacggccacgtggcactccagacgtacggtcagtgtccgaggtcgggtctagggacagtacttcactctcactactcaccgagactggactcgtagatcgttagtttgacgttagtttcgtttttctgtactacgacgtagttagtaggtacgttaccgtacgttaccggaactacgttaccgggaccgtaacggggtaacccgaagggttaacggaaacttaacccggaaaacggtacgtacgggtacggactacggacctaaccgtnttaccgtnttacccgtattaccgtcccttcccgtaccg

SEQ ID NO: 106729 - DNA, 586 bp, Homo sapiens
  misc_feature: GYAE6OF01D9SAZ.48.71.G05.1.454.CMB.1.raw
  modified_base (202)..(202): a, c, t, g, unknown or other
  misc_feature (202)..(202): n is a, c, g, or t
  modified_base (429)..(429): a, c, t, g, unknown or other
  misc_feature (429)..(429): n is a, c, g, or t
  modified_base (553)..(553): a, c, t, g, unknown or other
  misc_feature (553)..(553): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccacctctcctgtaggccagtcagaatgttaagagccactccttagactggtaccagacaaaactcggcacgcctccagctcctcatctatgtgcgtccacgacgggccacgtggctactcccaagacgaggttcaggtggcaggtcgggtcgtgggacagacttcactctaccaccatcaaccagacgtgacgtcctgattgtatttgcttagttcgtttttcngttactagtctaagtagttaggtaacgttcgacccgtcgggactacggttccggaccgtaacgggggtacctaagggtacggaaactaccgaaaacggtaacgtggtacggtactagccacctnttccgttcgttacttactcttccctcccggtac

SEQ ID NO: 106730 - DNA, 613 bp, Homo sapiens
  misc_feature: GYAE6OF01DXNPZ.48.71.G05.1.454.CMB.1.raw
  modified_base (204)..(204): a, c, t, g, unknown or other
  misc_feature (204)..(204): n is a, c, g, or t
  modified_base (400)..(400): a, c, t, g, unknown or other
  misc_feature (400)..(400): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccaccctctcctgtaggccagtcagaatgttaagcgccactccttagcctggtaccagacaaaaacctggccagcctccaggctcctcatctatggtgcgtccaccgagggccactggcactcccaagacaggttcaggtggctaggtcgggtctggggacagacttcactctacacctatcacagactggacncctgatgtattttgctagtttgtttttctgttcagtctagttagtggtaacgttcgaaccgtacgggtactacggtttccggaccggtaacggggaaccgtaagggtacggtaaaacgtaccgtaaaaccggtaacgttcgggttacggcgttacggaccctaacctagttacccttggttaccttcctaaccttcccgtttccccgtacccg

SEQ ID NO: 106731 - DNA, 584 bp, Homo sapiens
  misc_feature: GYAE6OF01AJDTQ.48.71.G05.1.454.CMB.1.raw
  modified_base (202)..(202): a, c, t, g, unknown or other
  misc_feature (202)..(202): n is a, c, g, or t
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtaggccagtcagaatgttaagagccactccttagcctggtaccagacaaaacctggccagcctccaggcctcctcatctatcggtgccgtccaccgagggcccacgtggcactcccagacaggttccaggtggctaggtgggtcgtgggacagtacttcactctcaccatccaccagactggacnctgatgtatttgcttagtttnttttcgcgttcagtcgtagttagtggtaacgttccacgtcggtactaggttccggacggaagggtacccgaaggtacggaaactacgaaaacgtacgtggtcggtactacggctaacccgtagtcgttcgttaccttacgtactttcccgttcccgtaccg

SEQ ID NO: 106732 - DNA, 533 bp, Homo sapiens
  misc_feature: GYAE6OF01B7M76.48.71.G05.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccacctctcctgtaggccagtcagaatgttaagngccatccttagcctggtaccagcaaaaacctggccagcctcccaggctcctcatctatggtgcgtccaccaggccactggcatcccagacaggttcagtggcagtggtctgggacagacttcactctcaccatcacagactggagcctgatgattttgctagttgttttctgtcagcagtatggaacgtttcaacctcggactagtttccggaccaggggacccaagggtcggaaaattcgaaaaccgaacttggtggctaggccaccattctgttctacactccttcccggacc

SEQ ID NO: 106733 - DNA, 591 bp, Homo sapiens
  misc_feature: GYAE6OF01C0TD1.48.71.G05.1.454.CMB.1.raw
  modified_base (459)..(459): a, c, t, g, unknown or other
  misc_feature (459)..(459): n is a, c, g, or t
  modified_base (546)..(546): a, c, t, g, unknown or other
  misc_feature (546)..(546): n is a, c, g, or t
  modified_base (578)..(578): a, c, t, g, unknown or other
  misc_feature (578)..(578): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagcgccaccctctcctgtacgggccagtcagaattgttaagagccactccttagcctaggtaccagacaaaacctggaccagcctacccaggcctcctcactctatcggtacgccgtccaccgagggcccacgtggccacgtaccccaggaccaggttcaggtggcgaggtggggtctggggacaggtaccttcgactcctcaaccactaccaccgagactggactccgtgattgtatttgcttagtttcgttttcngtcagtctagttagtacggtagttacaccgttacggactacggttcggaccggagggtaaccgtagggtagaactacgaaacgtagngtcggctacgacacgtattcgtcgttacttanactccctccgtac

SEQ ID NO: 106734 - DNA, 607 bp, Homo sapiens
  misc_feature: GYAE6OF01E2H2L.48.71.G05.1.454.CMB.1.raw
  modified_base (203)..(203): a, c, t, g, unknown or other
  misc_feature (203)..(203): n is a, c, g, or t
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaaacctggccagcctcccaggctcctcatctatggtgcgtccaccagggccactggcactcccagacaggttcagtggcagtgggtctgggacagacttcactctcaccatcaccagactggancctgatgtattttgctagtttgttttcngtcagtctagtagtggaacgttcaccgttcggactacgtttccgggaccgtaacgggggaccctaaaggggtacggaaaacttaccgaaaaaccggtaacgttgggtacgggtaccgttacggaccctaacccgtacgttcccgttacggttacctttaccaactttccccgttcccccggtaaccc

SEQ ID NO: 106735 - DNA, 762 bp, Homo sapiens
  misc_feature: GYAE6OF01EPZIX.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgtctccagggaacncgccaccctctcctgtagggccagtcagaatgttaagagccaactccttagcctaggtaccagacaaaaccgtggaccacgcctcccgagcctcctacatctagtcggtgccgtccaccgacgggccacgtcggaccactccccagaactacggttacaggtcggcgtaacggttcgggtcgtacggggaacaacggtaccttacctacgtaccttacccgaaccacgttaccaacccaaggtaacccgttggggaacttcccgttaggtaacgtttacgttacgtttttacgacgtttaaggttttcgttttttaccgtcgttaccgtaacgtccgtttaaggttacggttacgggttaaccgtttcccgtaaccggttccgggtaaccttacggtttacccggggaacccggtaagggggttaaccccaaacgggggttacgaaaaaccgttaccgaaaaaccgggtacgttagggtaccggtactacggtacccaacccgttaattcccgtttacgttaccctttacccgtaacgtttccccgttaccccgtaccg

SEQ ID NO: 106736 - DNA, 629 bp, Homo sapiens
  misc_feature: GYAE6OF01EMLEV.48.71.G05.1.454.CMB.1.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccaccctctcctgtagggccagtcagaatgttaagagccactccttagcctggtaccagcaaaacctgccagcctcccagctcctcatctatggtgccgtcccaccgacgggcccacgtggcactccccagaccgtaggttcagtcggctaggtgggtcngggacagtacttcactctacgaccactccaccagacgtggacgcctagacgttgtattttcgctagtttcgtttttactgtcgtagtcgtagttagttggtaagtttccaccgtcgggtaactacgtttaccgggaccgtaacggggaaccgtaagggttacggtaaactaccggtaaaaccggtaacgttacgggtacggtacctaggacccctacgtacgttccgttacggttaccttacctctttccccgttcccggtaccc

SEQ ID NO: 106737 - DNA, 619 bp, Homo sapiens
  misc_feature: GYAE6OF01AD6VS.48.71.G05.1.454.CMB.1.raw
  modified_base (204)..(204): a, c, t, g, unknown or other
  misc_feature (204)..(204): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctgtagggccagtcagatgttaagagccactccttagcctggtaccagacaaaaacctggccagccctcccgaggcctcctcatttatgatacactcccaccacgggccacctgggtcgtcccacgcccaggttccacgtgggcgggtggggtcgtagggacaggacgttcactctccaccactcagcacgtcctgcgagtcctgtaacgttattttactatttttacttacttgtactagtctaagtattacggtaagtggtaccttccggttacggtttcggacccgaaagggtacccgtaaggggtacggaacgtaccgaaacgtacgtggtcggctcggacctaccgtattcgtacgttcccttactacttcccgttacccgtacctagttcgttacg

SEQ ID NO: 106738 - DNA, 625 bp, Homo sapiens
  misc_feature: GYAE6OF01AXLSK.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngccactccttagcctggtaccagcaaaaacctggccagcctcccaggctcctcatctatggtgcgtccaccagggccactggcactcccagacaggttcagtggcaggtgggtctgggacagacttcactctcaccatccaccagactggacgcctgactgtattttcgctagtttcgtttttcgtgttccagtctaagttacgttaggtaacgtttccgaaccgttccggaacgtacggttccgggaccgaacgggggtaaccctaagggttacgggaaaactaccgtaaaaaccggtaacgttgggtacggtacgtacggtaccaacccgtagttaccgttacgtttaccctttactaccgtttcccgttaccccggtaccc

SEQ ID NO: 106739 - DNA, 575 bp, Homo sapiens
  misc_feature: GYAE6OF01AYM5V.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctgccagcctccaggcctcctcatctatggtgcgtccaccaggccactggcatcccagacaggttcagtggcagtggttctgggacagacttcactctcaccatccaccagactggagcctgatgtatttgctagtttgtttttctgttcagtctagttagtggtaattccgtaaccgtcggactacgttccgggaccgacggggtaaccaagggttacggaaactacgaaaaccggtacgttggtcggtactcggaccacccgtattccgttcgttccttaccactttcccgttccccgtaccg

SEQ ID NO: 106740 - DNA, 558 bp, Homo sapiens
  misc_feature: GYAE6OF01C541R.48.71.G05.1.454.CMB.1.raw
  modified_base (202)..(202): a, c, t, g, unknown or other
  misc_feature (202)..(202): n is a, c, g, or t
  modified_base (426)..(426): a, c, t, g, unknown or other
  misc_feature (426)..(426): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccacctctcctgtagggccagtcagaatgttaagagccactccttagcctggtaccagacaaaacctggccagcctcccaggctcctcatctatggtgccgtccaccgagggccacgtggcactccccagacaggttcagtggcagtgggtctgggacagcttcactctcaccatcaaccgagactggacgcctgatgtattttgacttagttcgtttttcngttcagctaggttatgggtaattccaaccgtcggactagttccggaccaggggaccaagggtaggaaatacgaaacgtactggtcggtctaggccaacctattctgttacttactcttcccgttcccgaccg

SEQ ID NO: 106741 - DNA, 699 bp, Homo sapiens
  misc_feature: GYAE6OF01DKH3H.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaagcgccaccctctcctgtagggccagtcagaatgttaagagccactccttagcctggtaccagacaaaacctggccagcctccaggcctcctcatctagtggtgccgtccaccgacgggcccacgtcggccactccccagaccgtaggttcgaggtcggcgaggtgggtcgtagggacagtacttcacttcctccaaccataccaccgagtacgtggtacgccttagattagttagttttcgcgttaagtttcggtttttcctggttaccagtactaaggttagtacgggttaactttccgtaaccgttaccgggaccgtttacgttcccggggacggttaacggggggtaaccgtaaggggttaacggaaaaaccgttaccggaaaaaccgggttaaccggttcgggtacggtaccgttacggaacccctaaccgttaacgttcccgtttacgtttacccgtttaccttaccgttcccccgtttcccccggtaaccg

SEQ ID NO: 106742 - DNA, 576 bp, Homo sapiens
  misc_feature: GYAE6OF01BXOS7.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngccactccttagcctggtaccagcaaaaacctggccagcctcccaggctcctcatctatggtgcgtccaccaggccactggcatcccagacaggttcagtggcagtggtctgggacagacttcactctcaccatcaccagactggancctgatgtattttgctagttgtttttcngttcagtctaagttagtggtaacgttcaccgtcggactagttccgggaccgtacggggaccctaagggtaggaaaactaccgaaaacggtaacgttggtcggtctacggacctacccaagttccgttcggttacctttaccacttcccgttccccgtacc

SEQ ID NO: 106743 - DNA, 640 bp, Homo sapiens
  misc_feature: GYAE6OF01D2D8I.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaagcgccaccctctcctgtagggccagtcagaatgtaagcgccactctagcctggtaccagacaaaacctggccacgcctcccaggcctcctcatctagtggtgcgtccaccgacggccacgtggcactcccagactaggttcgagtcggcgaggtgggtcgtgggactagtaccttcactctaccacctactccaaccagtacgtggactcctagatttcgttagttttcgacgttaggttttcgttttcgtgttacgacgtacgtaagttagttaggtaaccgttccaaccggttacggtaccgttacggtttacccgggaccggtaacggggtaaaccgtagggtaacgtaaacgtaccgaaaacgtacgtcgggtacgagttacgaccgtaactacgttcgttcgttaccttacctacttcccgtacccgtacccg

SEQ ID NO: 106744 - DNA, 771 bp, Homo sapiens
  misc_feature: GYAE6OF01D8NZC.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccacctctcctgtagggccagtcagaatgttaagagccactccttagcctggtaccagacaaaacctggccagcctccaggctcctcatctatggtgcgtcccaccgacgggccacgtcggcactaccccaagactaggttcaggtcggacgtaggtcggggtctggggaaccacggtacttaccgacttcctacccgaaccctactacccaaccgtaacgaccgttacgggaacgtacccttaggtaactttagggttacttttttggaccgttaaggttttcggtttttttacgtacggttccgaagtccgttaaggtttaacggttacgggttaaacgttttacccgaacccgtttccggggaaacctttacgggtttcccggggaaacccggtaagggggtaaccccgtaaaggggttaacggtaaaaacctttaaccggaaaaaccggttaaccgttacggggttaccgggtaccgtttaccgggacccaaacccgttagttacccgtttacgggttttaccctttacccgttaaacgtttcccccgttaccccggtaaccc

SEQ ID NO: 106745 - DNA, 594 bp, Homo sapiens
  misc_feature: GYAE6OF01D6L1T.48.71.G05.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgctccgaggggaacncgccaccctctcctgtacgggccagtcagaatgttaagngccactccttagcctggtaccagaccaaaaacctggccacgccctcccaggcctcctcatctagtggtcgccgtccaccgacgggcccacgtggccactcccgagactaggttcaggtggacaggtcgggtcgtagggacagtaccttcactctccacctataccaccgagacgtaggacgcctagatgtatttgctagtttcgttttctgtcagtctagtagtggtacgttcactacggactacgttcggaccgagggaccgtaagggtacgtaaacgtaccgaaacggtaacgttggtcgtctacggccaccgtattcgttacttcttactaccttcccgtcccgtacc

SEQ ID NO: 106746 - DNA, 566 bp, Homo sapiens
  misc_feature: GYAE6OF01A7SBA.48.71.G05.1.454.CMB.1.raw
  modified_base (422)..(422): a, c, t, g, unknown or other
  misc_feature (422)..(422): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgtaagagccactccttagcctggtaccagcaaaacctggccagcctcccaggctcctcatctatggtgcgtcccaccgagggccactggcatcccagacaggttcaggtggcaggtgggtcgtgggacaggacttcgactctcaccatcaccagactggagcctgatgtattttgctagttgttttcngttcagtctagtagtggtaagttcaccgtcggtactagttccgggaccgtaaggggaccaagggtacggaaactacgaaaaccgtacgtagggtcggcttagccaacctatccgttgttacttacgacttcccgttccccgtac

SEQ ID NO: 106747 - DNA, 607 bp, Homo sapiens
  misc_feature: GYAE6OF01BT6IQ.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngccactccttagcctggtaccagcaaaaacctggccagcctcccaggcctcctcatctatggtgcgtcccaccgagggccactggcatcccagacaggttcagtggcagtgggtctgggacagacttcactctcaccatccaccagactggancctgatgtatttgctagttgtttttcngttcagtctagttagtaggtaacgtttcaaccgttcggactacgtttccgggaccgtaagggggaccctaaggggtacggaaaactacgtaaaaccggtaacgttggtacggtacgttacggaccctaacccgtagttaccgttacggttaccctttacctactttccccgttcccccgtaacccg

SEQ ID NO: 106748 - DNA, 560 bp, Homo sapiens
  misc_feature: GYAE6OF01B7YT0.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagatgtaagagccactcctagcctggtaccagcaaaaacctggccagcctcccaggctcctcatctatggtgccgtccaccgagggcccactggcactcccagacaggtcagtggcagtgggtctgggacagacttcactctcaccataccaccgagactggacgcctgatgtattttgctagtttgttttctgtcagctagtagtggtaacgttcaccgttcgacgtagttccgggacccgaggggaacccgagggtacgaaactacgaaacgtacgtgtcggtctagccgacctagttcgtacgttacttaactccgttcccgcttaacg

SEQ ID NO: 106749 - DNA, 576 bp, Homo sapiens
  misc_feature: GYAE6OF01BES07.48.71.G05.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
  modified_base (415)..(415): a, c, t, g, unknown or other
  misc_feature (415)..(415): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtaggccagtcagaatgttaagagccactccttagcctggtaccagcaaaacctggccacgcctccagctcctcatctatggtcgccgtccaccgacggccacgtggcactcccagacgaggttcagtgcaggtgggtcngggacagacttcactctcacatcacagactggacgtcctagattgtatttgctagtttnttttctgtcagctagtagtaggtacttcgaccgtcgactcgttaccgggaccgtaacggggacctaagggtacggtaaacgtacgtaaaccggaacgttcggtcggtctacggtacacccgtattcgttacgttactttaccacttcccgttacccgtacc

SEQ ID NO: 106750 - DNA, 554 bp, Homo sapiens
  misc_feature: GYAE6OF01BNBE6.48.71.G05.1.454.CMB.1.raw
  modified_base (202)..(202): a, c, t, g, unknown or other
  misc_feature (202)..(202): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactccttagcctggtaccagcaaaaacctggccagcctcccaggctcctcatctatggtgcgtccaccgagggccactggcactcccagacaggttcagtggcagtgggtctgggacagacttcactctcacatccaccagactggagcctgatgtattttgctagttnttttcngtcagctagtatggaacgttcacctcggactagttaccggcgtacggggactaagggtacgaaataccgaaaacgtacgttaggtcggactcggaccacctagtcgttcgttcttactacttcccgttcccgtacc

SEQ ID NO: 106751 - DNA, 709 bp, Homo sapiens
  misc_feature: GYAE6OF01B0ZS8.48.71.G05.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctcaggcaccctgtctttgtctccgaggggaancgccaccctctcctgtaggccagtcagatgttaagacgccactccttagcctggtaccagcaaaaacctcggccacgcctccaggcctaccttatcctatcggtnccgtaccaccgacggcccacgtggaccactcccgagtaccgtaggttcaggtcggcgtaggttcgggtacgtgggaacagtaccgttcaccttctaccgacctactccgaaccagtacgtggaacgtccgtaggtacttacgttacttttggacgttagtttcgtttttcgtcgttactacggtacgtaggttacgttagggttaaccgttcgttaacccgtaccgggtaaccgttacgttaccgggtaacccgggtaagggttaacccggtaagggttaacggtaaaacgtaaccggtaaaaccggtaaacgttcggttacgggtaccgtacgaacctacccgtagttaccgttacgtttacccttagtaacccgtttcccgttaccccgtacttaaccgg

SEQ ID NO: 106752 - DNA, 646 bp, Homo sapiens
  misc_feature: GYAE6OF01DGZIP.48.71.G05.1.454.CMB.1.raw
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaagccgccaccctctcctgtagggccagtcagaatgttaagagccactccttagcctggtaccagaccaaaacctggccacgcctcccaggcctctcatctagtgggtgccgtccaccgacgggcccacgtggccactcccagactggttacaggtggcgaggtcgggtcgtagggactagtacttcactcaccacatccaccagacgtcggacgcctagatgttatttcgcttagtttcgttttactgtcgtagcgtagttagtagggtaacgttccaaccgttacgggtaacttacggttccgggaccggacgggggaaccctaaggggtacgtaaaacgtaccgaaaaaccggtagtacgggtcggtacgtcggaccctaacccgtagtttcccgttacgtttaccctttacctaaccgtttccccgttaccccggtaaccc

SEQ ID NO: 106753 - DNA, 604 bp, Homo sapiens
  misc_feature: GYAE6OF01CG91Z.48.71.G05.1.454.CMB.1.raw
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaanccgccaccctctcctgtagggccagtcagaatgtaagagccactccttagcctggtaccagcaaaaacctggccagcctccaggctcctcatctatggtgccgtccaccagggcccactggcactcccagacaggttcagtggcaggtggtctgggacagactcactcncacatcacagactggacgccgtnatgtattttgctagtttgttttctgtcagtcgtaagttagtaggtaacgtttccgaccgtcgggtaactacggtttccggaccggtaacgggggaaccgtaaggggttaacggaaaaccgttacgaaaaccggtaacgttacggtccgggtactacggaccaaccgtacttccgttacgttaccttactccttcccgttcccgtacccg

SEQ ID NO: 106754 - DNA, 795 bp, Homo sapiens
  misc_feature: GYAE6OF01AUAB2.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtacgggccagtcagaatgttaagagccactccttagcctggtaccagacaaaaacctggaccacgcctacccgaggcctcctcactctagtcggtacgtcgtccaccgacgggccacgtcggcacgtccccagaccgtacggttcgaggtcggcgaggtcggggtcgtaggggactacggtacttccgacgttcctacctacccgtactaccaacccgtaacgtaccgttacgggaacggtcccgtaggtaacgttagggtaacttttttacggcccgttaaggtttttcggtttttttacccgttacggttacccgtaaaggtacccgttaagggtttaaccggtttacggggtttaaaccggtttacccgtaaacccggttaccgggttaacctaaccgggttttacccgggacccggttaacgggggaaccccgttaaaggggtacggtaaaacgtacccgaaaaaccgggtaaccgttacggggtaccggtaccgttaacggacccgtaacccgtacgttaccgttaccggtttaccgtttacccgtacctttccccgttaccccggtacccg

SEQ ID NO: 106755 - DNA, 618 bp, Homo sapiens
  misc_feature: GYAE6OF01B0R4I.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccagggaagcgccacctctcctgtagggccagtcagaatgttaagagccactccttagcctggtaccagacaaaaacctggaccagcctcccaggctcctcatctatggtgcgtccacgagggccactggcactcccagacaggttcaggtcggcaggtcgggtctgggacaggtacttcactctcacctatccaccagactggacgcctgatcgtattttcgacttagtttcgtttttctgttacagtctaaggttagtgggtaaacgttcctaaccgttccggacctagtttccgggaccggtaacggggtaacccgtaagggtacggaaacgtaccgaaaacgtaaccggtggtacgggtcttaggccctaccgtaacttccgttacgttccctttaccgtactttcccgttccccggtaccc

SEQ ID NO: 106756 - DNA, 664 bp, Homo sapiens
  misc_feature: GYAE6OF01BWS38.48.71.G05.1.454.CMB.1.raw
  modified_base (201)..(201): a, c, t, g, unknown or other
  misc_feature (201)..(201): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccagggaancgccacctctcctgtacggccagtcagatgttaagagccactccttagccttggtaccagacaaaacctggaccacgcctcccaggcctcctcatctagtggtcgccgtccaccgacggccacgtggacactcccgagacgtaggttcaaggtggacgtaggtcgggtcgtggggacagtacttacactctaccacctactaccaaccgagtaccgtaggacgtaccgtgtaacttggttattttcggacgttacgtttcgtttttacgtagttacgtagtactacggttagttaggtaaccgtttcgtaaccgttacggtaacgtacgtttaccgggaccggtaacggggaaccgtaagggttacggaaaacgttaccgaaaccggtaacgttcggtacggttacgtaccggtacctaccgacttcgtacgttacttaccgacctttcccgtccccgtaccg

SEQ ID NO: 106757 - DNA, 686 bp, Homo sapiens
  misc_feature: GYAE6OF01D6ILG.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaancgccaccctctcctgtacggccagtcagaatgttaagacgccactccttagcctggtaccagacaaaacctggaccacgcctccgaggcctcctcactctagtggtcgccgtcccaaccgacgggcccacgtggccactcccagactaggttcaggtcggcgtaggtcgggtcgtacgggacacggtacttacaccgtctaccgacctactaccaaccgaggtaaccgtcggaacgtcccgttagacgttgttacttttcgacgtttacggtttcgtttttcgtacgttcgtaacggtacctaaggttacgttacgggttaacgttaccgtaccgtacggtacttacggttaccgggaccgtaaacgggggtaacctaaaggggtacgtaaaacgtaccgtaaaacggtacgttggtacggtacgtacgtaccctacgtacgttcgttacggttacctttacacctttcccgtacccggtacc

SEQ ID NO: 106758 - DNA, 670 bp, Homo sapiens
  misc_feature: GYAE6OF01DC6U9.48.71.G05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaancgccaccctctcctgtagggccagtcagaatgtaagngccactccttagcctggtaccagacaaaacctggccagcctccaggctcctcatctatggtcgcgtccaccgagggccacgtcggcactcccagacgtaggttcaggtgcgtaggtcggggtctagggacaggacttcactctcaccatccaaccgagactgggactccgtgtagttcgtagttttcgacgttagtttcggtttttactgttactacggtcttaaggttacgttagggtaactttaccgacccgttacgggaaccgttaggtttcccgggaccggtaacggggtaacccgtaaaggggttacggaaaaacgttaccgaaaaacgggtaccgttagggtccgggtaactacggaccctaacccgtaatttaccgttacggtttacccttaacgttccgtttccccgttaccccggttaccc

SEQ ID NO: 106759 - DNA, 697 bp, Homo sapiens
  misc_feature: GYAE6OF01AIETW.48.71.G05.1.454.CMB.1.raw
  modified_base (246)..(246): a, c, t, g, unknown or other
  misc_feature (246)..(246): n is a, c, g, or t
  modified_base (420)..(420): a, c, t, g, unknown or other
  misc_feature (420)..(420): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgtctccgaggggaaacgccgcccaccctctcctgtacgggccagtcagatgttaagngccactctagcctggtaccagacaaaaacctggaccacgcctcccgacggcctcctcatctagtggtcgcgtccaccgacggccactcggcactcccgagacgtaggtcacgtggcaggttgggtcgtagggacacgtacttctacgtctcacctactccaccagactcggacnccgtagatagtagttttcgacgttacggttttcgtttttcgtcgttacgtacggtacttaaggtttagttacggttaaccgtttaccgtaccggttacggaacttaccgggttaccgggacccgggtaacgggggaaacccgtacggggtaacgggtaaactaaccggtaaaaccggtaaccggttgggtaccggtaccgtacggtaacccaaccggttacttaccgtttaccgttaccctttaacccgtccctttcccggttcccccgttaaccgg

SEQ ID NO: 106760 - DNA, 791 bp, Homo sapiens
  misc_feature: GYAE6OF01DG4KH.48.71.G05.1.454.CMB.1.raw
  modified_base (197)..(197): a, c, t, g, unknown or other
  misc_feature (197)..(197): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtcttgctcagggaancgccacctctcctgtaggccagtcagaatgtaagagccactcctagcctgtaccagcaaaactgcagcctccagctctcatctatggtgcgtccacgacggccacgtcggactactcccgaagaccgtaggttcacggttacggccgtaagggttcgggtcgttacggggaacgtaacggtaccttaccgtacgttcctaccctaaccgtaacttacccgaaccctacggtaaccgtcgggaacgttacccgttacggtaacgttacggttaacgtttttcggtaacgttaacggtttttcggttttttaccgtcggtttaaccggtaacgttaccgttaagggtttaacgtttaacggggtaaccgttttacccggtaacccgttaaccgggtaaccttaccgggttttaacccggggaaccggttaaacgggggtaacccgtaaacggggttacgggtaaaaaccgttaacggtaaaaacccggtaaaggttacgggttaaccggacgttacggtacccgtaacccgttaacgtttaccggttaccggtttactttaacccgtaccgtttccccggtttaccccgtaacccg

SEQ ID NO: 106761 - DNA, 768 bp, Homo sapiens
  misc_feature: GYAE6OF01C635N.48.71.G05.1.454.CMB.1.raw
  modified_base (199)..(199): a, c, t, g, unknown or other
  misc_feature (199)..(199): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcacctgtcttgctcgagggaanccgccacctctcctgtaggccagtcagaatgtaagacgccactcctagcctaggtaccagacaaaactggccacgcctccacggctcctacactctagtcggtcgccgtccaccgacggccacgtcggcctactcccgaagactaggttcaggtgcgtaggtcgggtctagggactaggtaccttcgactacctaccgacctaataccaaccgtacggtacgtacggtacgtccttaggtagttacgttacgttttcggtaccgtttaggttttccggtttttacgtacggttacctaacgggtaccttaagggtttaacgttaacgggttaaccgtttacccgtaacccggttaacggggtacccgttaacgggtttaccccgggaacccgggtaaacggggtaaacccggtaaggggttaaacggtaaaaccgttaccggtaaaaacccggtacggttacggggttacggtacccgtaacggtaccccgtaaccgttacggtttaccccgttacggtttaacccttacccgtttaacctttcccccgggttaacccccgttaacccg

SEQ ID NO: 106762 - DNA, 597 bp, Homo sapiens
  misc_feature: GYAE6OF01D7X0Q.48.71.G05.1.454.CMB.1.raw
  modified_base (204)..(204): a, c, t, g, unknown or other
  misc_feature (204)..(204): n is a, c, g, or t
  modified_base (553)..(553): a, c, t, g, unknown or other
  misc_feature (553)..(553): n is a, c, g, or t
  modified_base (564)..(564): a, c, t, g, unknown or other
  misc_feature (564)..(564): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccaccctctcctgtagggccagtcagaatgttaagagccactccttagcctggtaccagacaaaaacctggccagcctcccaggctcctcatctatggtgccgtccaccgagggccacgtcggcactcccagactaggttcaggtggcaggtgggtcgtgggacagtacttcgacttctacaccatccaccgagacgtggacgtcctgattgttagttttgacttagtttgtttttctgtctagcgtagtagtaggtaacgttcaccgtacggtacgtacgtttccgggaccggtaacggggtaacccaagggtaacggtaaataaccgaaacgtacgttggtacgntacggcacctnttacgtcgtccttacgtacttcccgtcccgtac

SEQ ID NO: 106763 - DNA, 734 bp, Homo sapiens
  misc_feature: GYAE6OF01ECPBG.48.71.G05.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (375)..(375): a, c, t, g, unknown or other
  misc_feature (375)..(375): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctcaggggaancgccaccctctccgtgtagggccagtcagtaatgttaagngccactccttagcctggtaccagacaaaactggccacgcctccgagctcctcatctagtgcgcgtaccacgacggccacgtggacactcccgagacgtaggttcagtcggacgtaggtgggtacgtagggaacncgtacttcacttcctaccaccataccaccgagtactggactcctagtacgttgttaattttgacgttaggttttcgtttttctaggttacctacgtaccgttaggttaacgttagggttaaccgtttaccgaaccccggtttacgggtaacccttacgggtttacccggggaaccggtaaaccgggggtaaccgaaacggggtttaacgggaaaaacttaacccggaaaaaccggttaacggttaccgggtttaccggggtacccttaacgggtaacccctaaaccccgttagtttaacccggttccggttttaaccctttacccggtaaccttttccccggttaccccccggtaaccc

SEQ ID NO: 106764 - DNA, 594 bp, Homo sapiens
  misc_feature: GYAE6OF01EV0XI.48.71.G05.1.454.CMB.1.raw
  modified_base (304)..(304): a, c, t, g, unknown or other
  misc_feature (304)..(304): n is a, c, g, or t
  modified_base (430)..(430): a, c, t, g, unknown or other
  misc_feature (430)..(430): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtnccgtcccgaaccggccgacctcggcactcccacgacgacggttcgacgtggcgagtgggtcgtgggacgagacgttcactctcaccactcaccacgactcggacgcctgatgtagttttgtcgtgntttgtttttcttgtcgtagcgtagttagttaggtaacgttcctaccgtcggtaccgtacgttccggaccgacggggtaaccgtaacgggtagggtaaactaccgaaacgaacgttcgtaggcgtcgacctaccactcttcgtactttcctacgttccgttcccg

SEQ ID NO: 106765 - DNA, 848 bp, Homo sapiens
  misc_feature: GYAE6OF01B93DW.48.71.G05.1.454.CMB.1.raw
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggccaccctgttctttgtctccgaggggaaagcgccaccctctcctggtacggccagtcagaatgttaagagccactccttagcctggtaccagaccaaaaaccgtcggccacgccctcccgacggcctcctcatctatcggtgccgtccaccgacgggccacgtcggcactccccgaagacgtacggttccgaaggtcgggacgtacggtcggggttacgttacgggggaacctacgggtacctttccgtaaccgttcctacccgtaaccctaacttaccccgaacccgtaacggtacccggttagggaaccggtcccggtttagtacgtttaggtttaacgttttttacggtacgtttaacgggttttttcggttttttttccttacgggtttaccgttaaggtaccggttaaggtttaacgtttaacggggttaaaccgttttaccgtaaccccggttacgggttaaccggtaccgttttacccggggaacccgggtaaaccggggggtaaccccggttaaaggggttaacccgggtaaaacgtttaacccggaaaaccggttaaaccggttcgggtacccgggtacgtccggtaaaccccgtaccgttaacgttcccgttacgtttacccgtttaccttaacccgttccccgtttcccccggtaacccg

SEQ ID NO: 106766 - DNA, 570 bp, Homo sapiens
  misc_feature: GYAE6OF01BP4OK.48.71.G05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (445)..(445): a, c, t, g, unknown or other
  misc_feature (445)..(445): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaancgccacctctcctgtaggccagtcagaatgttaagagccactccttagcctggtaccagacaaaacctggaccagccctccaggtcctccctctactntagtggtcgccgtccaccgacgggcccacgtcggcactcccagactacggtcagtcggcaggtgggtactgggacagtctacactcncactactcaccagctggacncctagtactgtagttttgacttggtttactttttcgngttcagtccgtagtagttagtacttccgaacgtcggacgttagtccggacgtacgggtacgaggtagaaacgtacaacgtagtggagtcgagcactattctacgttctactactcgttccgtacg

SEQ ID NO: 106767 - DNA, 737 bp, Homo sapiens
  misc_feature: GYAE6OF01BIA39.48.71.G05.1.454.CMB.1.raw
  modified_base (199)..(199): a, c, t, g, unknown or other
  misc_feature (199)..(199): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctcaggcaccctgtctttgtctcagggaancgccacctctcctgtaggccagtcagaatgttaagacgccactccttagcctggtaccagacaaaaacctggaccagccctccgagctcctcatctatggtgccgtccacgacggccactggcactcccaggaccaggttcagtcggcgtaggtggtctgggactaggtacttcgactctaccgacctactaccaccacgacgtaggacgacccgttagacgttacgttaattttcggacgttacgttttcgtttttacctaggttaccgacggtaccgtaaggttacgttacgggttaaaccgtttccgaacccggtttacgggaacccgtttaacgggtttccccggggaaccgttaaccggggggttaaacccgtaaacggggttaagggtaaaaaacctttaaccgggtaaaaacccgggttaaacgttggggttaaccggtaccgttacgggtaaccccttaaaccgtacggtttaacccgttagggtttaccccgttacctaaccgttttccccgttacccccgttaacccg

SEQ ID NO: 106768 - DNA, 674 bp, Homo sapiens
  misc_feature: GYAE6OF01CDQM4.48.71.G05.1.454.CMB.1.raw
  modified_base (204)..(204): a, c, t, g, unknown or other
  misc_feature (204)..(204): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgtctccgaggggaanccgccaccctctcctgtaggccagtcagaatgttaagacgccactcctagcctggtaccagacaaaactggaccagcctccagctcctcatctagtggtgccgtaccaccgacgggccacgtggacactcccagacaggttcaggtggcgaggttgggtctggggacacgtacgttcactctcaaccactaccaaccagtaccgtgggacgtccgtgtacttagtattttggacttagtttcgtttttctgtactacgtacgtagttagtacgggtaaacgttccgtaaccgttaccggaacttacggtttacccgggaccgggtaaccggggtaaccgtaaggggtaacggtaaaacgtaaccgtaaaaacggtaacggttacggttcgggtacctacgggtacctaaacccgtagttttaccggttaccgtttacttacccgtacctttccccgttccccgtaacccg

SEQ ID NO: 106769 - DNA, 709 bp, Homo sapiens
  misc_feature: GYAE6OF01A9L3U.48.71.G05.1.454.CMB.1.raw
  modified_base (199)..(199): a, c, t, g, unknown or other
  misc_feature (199)..(199): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcacctgtcttgctcaggggaacncgccacctctcctgtacggccagtcagaatgtaagacgcctacttccttagcctaggtaccagacaaaaacctcggaccacgccctcccgacggcctcctcactctagtggtcgccgtaccaccgacgggccacgtcggccactcccaggacgtacggttcgaggtcggcgtaggtcgggtacgtgggacgtagtaccttacacgtcctaccaccatccaaccgagtacgtcggacgtccgtagtacttacgttagttttcgacgtttacgttttcggtttttactcggttacaggtaccgtaaggttaacgttaggtaaccgtttccgtaaccgttaccgggtaaccgttacggttaccgggacccggtaaacggggtaaccgtaaagggttaacgggaaaacgttaaccggaaaacggtaaccgttgggtaccggtacgttacggacccgtaaccgtcgtttaccgttacgttacctttaccgtacctttaccccgttccccgtaccc

SEQ ID NO: 106770 - DNA, 641 bp, Homo sapiens
  misc_feature: GYAE6OF01D6WEV.48.71.G05.1.454.CMB.1.raw
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaagcgccaccctctcctgtagggccagtcagaatgttaagngccactccttagcctggtaccagacaaaacctggccacgcctcccaggctcctctatttangatacactccaccgaggccacgtgtcgtcccagcctaggttcacgtgggcggtgggtctgggacaggtacgttcactctccaccatccagccacgtcctgactagttcctagtaagttaattttactatttttaattacttgtctagtacagttactacggtaagtcggtaccgttccggtacggtttacggacccgtaaaggggtacccgtaagggttacggaaacgttaccgtaaaacggtaacgttgggtacgggtccgtacggtacctaaccgtacgttccgttacgtttcttacccgtactttaccccgttccccgtacctacgttccgttaagg

SEQ ID NO: 106771 - DNA, 554 bp, Homo sapiens
  misc_feature: GYAE6OF01ED6U4.48.71.G05.1.454.CMB.1.raw
  modified_base (204)..(204): a, c, t, g, unknown or other
  misc_feature (204)..(204): n is a, c, g, or t
  modified_base (387)..(387): a, c, t, g, unknown or other
  misc_feature (387)..(387): n is a, c, g, or t
  modified_base (431)..(431): a, c, t, g, unknown or other
  misc_feature (431)..(431): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctggtagggccagtcaagaatgttaagacgccaactcttagcctggtaccagacaaaactgccagcctccaggctcctcactctatggtgccgtccaccgaggccacgtggcactcccagacaggttcagtcggcaggtggtcgtgggacagtacttcactctccactanccacgagctggagtcctagattgtatttgcttagtttgttttcngtctagctagtagtggtaagttcacgtgactgttccgggaccgaaggggtaccaaggtagaaactacgtaaacgtagtggcgctaggcaacctatcgtcgtacttcacgttccctccgtaccc

SEQ ID NO: 106772 - DNA, 716 bp, Homo sapiens
  misc_feature: GYAE6OF01E5N2A.48.71.G05.1.454.CMB.1.raw
  modified_base (559)..(559): a, c, t, g, unknown or other
  misc_feature (559)..(559): n is a, c, g, or t
tcagagtatacatacacgaccggtgctcgatttagtgtcgtcgcaagagagaggggggaagagctgctcagttaggacccagagggaaccatcggaaaccccagcgcagtcttctcttcctcctgctactctggcctccagacaccgaccggaagtaaattggtgttcgacgcacgtcctccgacggcctacccgttgttctttcgtccgtaccggaaggggaacgccgccctaccctctccgtaggtacgggcctacgtacgaagtaactacgttaacgccgcctacttaccgtacgccgtacggtaaccacgaaccaaaaccgtcggaccaccgccctaccgacggtcctccgtactactcgtacgtcggtaccgccgtaccgaccggacggccgtacgtcgacctacctaccgacgtacggtacgtcgacggtcggtacgtcgggttcggtcgtacgggactacgtaccttcacctacctaccactactaccgaaccgacgtacggtcgaccgtacgtgtagttcgtttagtttcgtacgttgttttcgtttacgngtacgacgtacgtagttacgtacggttactcgacgtacgtacgtacggtaccggacggtaacggtacgtaaggtaacgaacgtacgtaaaccgagttcggtcacgtacgtccaacgttcttccgttacgttcctacgttccttcccgtcccgtaacg

SEQ ID NO: 106773 - DNA, 595 bp, Homo sapiens
  misc_feature: GYAE6OF01EHLN6.48.71.G05.1.454.CMB.1.raw
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgttctttgtctcgaggggaacgcgcccaccctctcctgtatggccagtcaagaatgttaagacgccacttccttagcctggtaccagacaaaacctggccagcctccgaggcctcctcatcttagtcggtcgccgtacccaccgagggcccacgtggcctactcccgaagaccgtaggtttcaggtcggcgtagggtgggtctagggacacgtacttccactcctccaaccatccaaccgagtaccgtggacgccgtgattgtatttcgngttagttntttttcngtcgagctagtatagtacgttcacgtcggactacgttccggacgacgggacgaaggtacgaaatacgaaacgtagtcggtacgacgtcgacctactagtcgtcgttacttactcgtcccgttacccg

SEQ ID NO: 106774 - DNA, 537 bp, Homo sapiens
  misc_feature: GYAE6OF01D8GMG.48.71.G05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
  modified_base (523)..(523): a, c, t, g, unknown or other
  misc_feature (523)..(523): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagatgttaagngccactccttagcctggtaccagcaaaaacctggccagcctcccaggctcctcatctatggtgcgtccaccagggccacgtggcactcccagacaggttcagtggcaggtggtctgggacagacttcactctccaccatcaccagacgtggacgtcctgattgtattttgcttagttgttttcngttcngtcagtatggtaagttcaccgtcggactagtccggacgagggacctagggtgaaactcgaaacgactggtcgntacgcactattcgtcgtcttanacttcctcccgtac

SEQ ID NO: 106775 - DNA, 911 bp, Homo sapiens
  misc_feature: GYAE6OF01DN3ES.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtcttgtctccgaggggaaacgcgccaccctctcctgtagggccagtcagaatgttaagcgccactccttagccgtagtaccaagaccaaaaaccgtggaccagccctacccacggcctccctcattcctaagtcgggtcgccgtacccaccgacggggacccacgtcggaccactaccccgaagtaccgtacgggttcgaacggtgggccgtaggggttacgggggttccgtacgggggtaaccgaaggttaacccgtttccaacccgtttacccgtacctaaaccccgtaattaccccgaaacccaacgggttacccgttaccgggggtaacggtacccctttagggtaacgtttacggtttaacgttttttacgggtaaccgtttaagggttttttccggttttttttacgtttaccgggttacgttaacggtaccgttaaagggtttaacggtttaccgggtttaaacgggttttacccaaacccgggtttaccggtaaaccgttacggggttttacccccgggaaccgggggttaaacccggggtaaacccgggttaaagggggttaaaccgggttaaaaaacccttacgggaaaaaacccggttaacggttaaccgggtacggggtacccgttacggaacccggttaacccgttaaccgttaaccggttttccggtttaacccttttacccgtaaccgttttcccccgtacccccggttaacc

SEQ ID NO: 106776 - DNA, 681 bp, Homo sapiens
  misc_feature: GYAE6OF01CFACO.48.71.G05.1.454.CMB.1.raw
  modified_base (530)..(530): a, c, t, g, unknown or other
  misc_feature (530)..(530): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggccaccctgtctttgtctaccgaggggaaacgccgccaccctctccgtggtacggccagtcaagtaagtgttaagacgcctacttacccgttagcccgtaggtacccaagaaccgtaaaaacccgtcggacccacgtccctaccgacggtcctacctctactctagtcggtcgccgtacccaccgacggccacgtcggacacgtcccaaggacctaggttaccgaacggtgaccgtaggtcggggtacgtaggggaacctacggtactaccgtactccgtaccaaccctatacccaaccgtagtacgtggaacgtctagtacgttcgttatttcgaccgttagtttcgttttcnggttacacggtctaggtacgtggtaacgttccgacgtacgacgttacgtaccgggacgaagggttaacccagggaactaactaacgaaacgtagtcggtacgtcgtacgccgtacctagttcgtacgttcttaccgtacttcccgaccgtc

SEQ ID NO: 106777 - DNA, 649 bp, Homo sapiens
  misc_feature: GYAE6OF01CNFPV.48.71.G05.1.454.CMB.1.raw
  modified_base (465)..(465): a, c, t, g, unknown or other
  misc_feature (465)..(465): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaacgccgcccacccctctcctggtacgggccagtcagaatgttaagacgccactccttagcctggtacccagaccaaaaaacccgtggacccacgcccctcccaacggcctccctcatctatggtcgccgtccaccgaggcccacgtcggcactcccagactaggttcaggtgcgaggtgggtcgtgggacagtaccttcactctcacctatccaccagacgtggacgtcctgtaatcgtattttcgcgttagtttcgttttcncgttacagtctaagtagtcggtaacgttcgtaccgtacggacgtacggttccgggaccggtaacggggtaaccgtaagggtaacggaaacgtaaccgtaaaccgggtacgtcgggtacggtccgtacgccgtaaccctagttcccgtacggtttccttacgtaccttcccggttcccgtacccg

SEQ ID NO: 106778 - DNA, 547 bp, Homo sapiens
  misc_feature: GYAE6OF01EJ51K.48.71.G05.1.454.CMB.1.raw
  modified_base (203)..(203): a, c, t, g, unknown or other
  misc_feature (203)..(203): n is a, c, g, or t
  modified_base (424)..(424): a, c, t, g, unknown or other
  misc_feature (424)..(424): n is a, c, g, or t
  modified_base (514)..(514): a, c, t, g, unknown or other
  misc_feature (514)..(514): n is a, c, g, or t
  modified_base (527)..(527): a, c, t, g, unknown or other
  misc_feature (527)..(527): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagaatgttaagagccactccttagcctggtaccagcaaaaacctggccagcctcccaggcctcctcatctatggtgcgtccaccgagggccactggcactcccagacaggttcagtggcaggtggtctgggacagacttcactctcaccatcaccagactggagcctgattgtattttgcttagtttgtttttacngttcagtctaaggttataggtaatttcaccgtcgtactagttccggccgaaggggaccaaggtacgaaatacaaacgtagtggtggtacngccgaacattctnttcttcattcccgtcccgac

SEQ ID NO: 106779 - DNA, 595 bp, Homo sapiens
  misc_feature: GYAE6OF01A18JM.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngccactccttagcctggtaccagcaaaaacctggccagcctcccaggcctcctcatctatggtgcgtccaccgacgggccactggcatcccagacaggttcagtggcaggtggtctgggacagacttcactctcaccatccaccagactggacgcctgattgtattttgctagttgttttctgtcagtcgtaagttagtaggtaacgttccaaccgtcggtaactaggttccggaccgtacggggtaaccaagggttaggaaacttacgaaaaccggtaacgttcggtacgggtctacggaccaaccgtacttacgtcggttaccttaccgtacttcccgttccccgtaacccg

SEQ ID NO: 106780 - DNA, 718 bp, Homo sapiens
  misc_feature: GYAE6OF01AGKRL.48.71.G05.1.454.CMB.1.raw
  modified_base (243)..(243): a, c, t, g, unknown or other
  misc_feature (243)..(243): n is a, c, g, or t
  modified_base (402)..(402): a, c, t, g, unknown or other
  misc_feature (402)..(402): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaagccgccaccctctcctggtacgggccagtcagaatgtaagngccactcctagcctggtaccagacaaaaccgtgccacgccctcccaggtcctcctcactctatcggtcgccgtcccaccgacgggccacgtggaccactacccgagaccgtaggttcaggtcggctaggtcgggtcgtgggacacgtaccttcacttcnccaccactccaccgagtacgtacggacgccttagtacgtagtttacttttcgacgtttacgtttttcggtttttactcggtttacgacggtacgttaaggtttacggttaacgggttaaccgtttacccgtaacccggttaccgggtaaccttaccgggttacccgggaaccgggtaaccggggtaaccgtaagggtaaacggtaaactaccggtaaaaccggtaacggttcgggttacggaccttacggaccctaacccgttagtttccgttacgtttacccttaccttacccgtttccccgttccccgtaaccg

SEQ ID NO: 106781 - DNA, 664 bp, Homo sapiens
  misc_feature: GYAE6OF01A1YFS.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaacctggccagccctccaggctcctcatctagtcggtgccgtccaccgacggccactcggcactcccagactaggttcgagtcggcaggtgggtcgtgggacagacttcactctcaccatccaccgagactgggactcctagattagtagtttgacgttagtttcgttttcgtcgtctaggtactaggttaagtttacgggtaacgtttcccgtaaccgttaccgggtaactaacggtttacccgggacccggttaacgggggaacccgtaaaggggtacgtaaaaaccgtaaccgaaaaaccggtaacggttacggtacgggtacgttacgggaccctaaaccgttacgtcccgtttaggttacccttaccgtactttcccggttcccgtaaccc

SEQ ID NO: 106782 - DNA, 609 bp, Homo sapiens
  misc_feature: GYAE6OF01AQ66O.48.71.G05.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccgganaaattgtgttgacgcagtctccaggcaccctgtctttgctccgaggggaaacnccgccaccctctcctgtacgggccagtcagaatgttaagcgccactccttagcctggtaaccagaccaaaaacctcggaccacggccctacccgaggcctccgtcactctatcggtcgccgtccaccgacggccacgtggcactcccagactacggttcagtcgcgagtggctgggacagtactcactctacacctatccaccagacgtcgacgtcctagatgttacttggcttagttcttttcgngtcagtctagttnaggttacgttcacgtacggacgtacgttcggaccgtagggaacctaagggtacgtaaacgacgtaaaccggtagttacgggtcgtacgtacggtccctaccgtacgttcccgttggttacccttatacccgttccctcccggtacc

SEQ ID NO: 106783 - DNA, 581 bp, Homo sapiens
  misc_feature: GYAE6OF01CECI1.48.71.G05.1.454.CMB.1.raw
  modified_base (204)..(204): a, c, t, g, unknown or other
  misc_feature (204)..(204): n is a, c, g, or t
  modified_base (375)..(375): a, c, t, g, unknown or other
  misc_feature (375)..(375): n is a, c, g, or t
  modified_base (427)..(427): a, c, t, g, unknown or other
  misc_feature (427)..(427): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccaccctctcctgtaggccagtcagaatgttaagagccactccttagcctggtaccagacaaaacctgccagcctccaggctcctcatctagtggtgccgtccaccagggccactggcatcccagacaggttcaggtggcaggtgggtctgggacagtacttcgactcncaccatccacagactggactcctgatgtattttgacttagtttgtttttcgngttacaggctaaggttagtagggtaacttcgaccgtacggactacgttcgggaccgaaggggtaacctaagggtacgaaaacgtacgaaaacggtaagtcggtaggctacgtccacctagtacgttgttaccttgaaccttccgttaccccgac

SEQ ID NO: 106784 - DNA, 736 bp, Homo sapiens
  misc_feature: GYAE6OF01BIP6G.48.71.G05.1.454.CMB.1.raw
  modified_base (151)..(151): a, c, t, g, unknown or other
  misc_feature (151)..(151): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccgganaaattgtgttgacgcagtctcaggcaccctgtcttgctccgagggaagcgccaccctctcctgtacgggccagtcaagaatgttaagagccacttcctagcctaggtaccagaccaaaaaccgtggaccacgccctccgacggtcctcctcactctagtggtcgtccgtccaccgacggccacgtcgctacgtccagacggtaggttacaggtcggacgtaggtcgggtacggtacgggactacgtaccgttccaccgtccgtaccaaccgtactaccgaaccgacgtacgtacggtacgtaccgtagtacgttacgttaagtttcgacgtttacggttttacgtttttcgtagttaccgtagttacgttaaggttacgtttaacgggtaaccgttcccgtaaccggtacgttacccggttaccgggttaccgggaacccgggtaacggggtaacccggttaagggtaaccggtaaaacgtaaccggaaaacgttacccggtaggttaccggtacgtaccgtacccgtaacgttacgttcccgtttacgttccgttaccgttacccgttcccgttccccggtaac

SEQ ID NO: 106785 - DNA, 621 bp, Homo sapiens
  misc_feature: GYAE6OF01BKPYN.48.71.G05.1.454.CMB.1.raw
  modified_base (245)..(245): a, c, t, g, unknown or other
  misc_feature (245)..(245): n is a, c, g, or t
  modified_base (607)..(607): a, c, t, g, unknown or other
  misc_feature (607)..(607): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaacgccgccaccctctcctggtagggccagtcagtaatgttaagngccactccgttagcctggtaccagccaaaaacctggaccagccctcccgaaggcctcctctatttatgtactacacttccaccgacgggcctacgtggtcgtacccagccgtaggttcacgtcgggtacggtgggtcgtaggggacagtacgttcactctcacctagtcagacacgtcctagcgtacgtctaggtaacgttattttaactatttttacttacgtgtcacgtcgtagttacgtacgtagtcggtaccttccggtagttcggaccgtaagggtaccgtaagggtacgaacgtacgaaacgtactcgtcggtacacggtacacgtattcgtcgttaccttctactccgttacccnctcgttcttaacgg

SEQ ID NO: 106786 - DNA, 738 bp, Homo sapiens
  misc_feature: GYAE6OF01ESQF8.48.71.G05.1.454.CMB.1.raw
  modified_base (201)..(201): a, c, t, g, unknown or other
  misc_feature (201)..(201): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaattgtgttgacgcagtctccaggccaccctgtctttgtctcgagggaanccgccaccctctccgtgtacgggccagtcagtaatgttaagacgccctacttccgttagccgtacggtaccaacgacctaaaaacccgtcggacccacgccctacccgacggtccttcctacctacttcctaagttcgggtcgcccgtacccaccggtacgggccctaccgtcggaccacttccccgaaggtaccgtaggttcgaggtcggacgtacggtgggtacgtgggaacacgtaccttaccacgtcctacgaacctactaccgaaccgagtacgtcggacgtcctagtagttacggttacttttagaccgtttaggttttaccgtttttctaggttaccgtacgttacgtaggtttaagttacgggtaccgttacccgtaccggttaccggtaaccgtcgtttaccgggacccggtaacgggaaccgttaagggtaacgtaaaccgttaaacgaaaccgtacggttcggtacgtacgtacgtacccacgttacttaccgttactaccgttactccttacccgtccgtaaccg

SEQ ID NO: 106787 - DNA, 706 bp, Homo sapiens
  misc_feature: GYAE6OF01DU7ZA.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagaatgttaagagccactccttagcctggtaccagacaaaacctggccagcctcccaggctcctcatctagtggtgccgtccaccgagggccacgtggcactccccgagacgtacggttacgaggtggacgtaggtcggggtcgtggggaacctacggtactttccgaccttccgtccaaccctactacccgaaccacggtacgtcgggacgtcccgttagtagttacgttagtttttcggacttaaggtttcgttttttacgtgttccgtaggtcctaaggttacgttagggtaacgttccgtaaccgttacggtaactaccgggttaccgggaccggtaacgggggaaccgtaaggggtacgtaaaacgtaaccgaaaaccggtaacgttcgggtcggtaccgtacggtacccaacccgtagttaccgtttcggttacctttaccgtaacccgtttccccgtttccccgtaacccg

SEQ ID NO: 106788 - DNA, 689 bp, Homo sapiens
  misc_feature: GYAE6OF01BMJC3.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccgaggggaancgccaccctctccgtgtacggccagtcagaactgttaaagcgccactccttagcctaggtaccagacaaaaacctggaccacgccctcccgacggctacctcactctagtggtcgccgtccgaccgacgggcccacgtcggcctaactcccgaagacgtaggtttccaggtcggcgtaggtcgggtcgtcggggacaggtaccttacgacctctaccgaacctatcccacctacggaccgttgggaacgtccgtagagttcgttacttttacggctttagttttcgtttttcgtacgttcgaagttactaggttaagttacggtaacgttaccgtacgttaccggtacgtacggttacccgggaaccggaacggggtaccgaagggttaacggtaaacgtacgaaaaccggtacgttaggtcggtacttacggaccgtaacctacttccgttacgttccttactccgtttacccgttccccgtaccg

SEQ ID NO: 106789 - DNA, 763 bp, Homo sapiens
  misc_feature: GYAE6OF01DOOHQ.48.71.G05.1.454.CMB.1.raw
  modified_base (205)..(205): a, c, t, g, unknown or other
  misc_feature (205)..(205): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggcctcccagaccaccaccggagtaattgtgttgacgcagtctccaggcaccctgtctttgctccgaggggaacnccgccctaccctcgtcctggtacggccagtcaagtaatgtaagacgcctactccttagcctaggtaccagacaaaccgtcgaccacgcctaccgaggcctacctactactccgttagtcggtacgtcccggtacccgaacccggtacggtacccgtacgtaccgggaccctaacgttaccccgaacgggtaaccgttacggggtttaccgacgggttaccgggaccgttaacgggttcggggttaccgttacggggaaacgtacgttacccgttaccgtaccgttccgtacctaccctagtaccgtacgcgtaacggtacggtcggacgtcctagtagttacggttaagtttcggtaacgtttggttttccgttttcgtacggttacgtaccgttagtaacggttagggttaccgttaaccggttaccgtaacccgttacggaccgttaacggttacccgggacgttaacggggaccggttaaggtaacggtaaacaccgtaaagtacgtcggtacgactcgactaccgacttcgtatccttactccgtcccggtacc

SEQ ID NO: 106790 - DNA, 664 bp, Homo sapiens
  misc_feature: GYAE6OF01BL5GV.48.71.G05.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcacctgtctttgtctccgagggaanccgccacctctcctgtacggccagtcagtaatgtaagngccactcctagcctggtaccagacaaaaaccgtggaccacgccctcccgaggcctcctcactctagtcggtacgccgtccaccgacggccacgtcggctactcccagacgtacggttacaggtcggcgtacggtcgggtcgtagggactacgtacttcactctacacctataccaccgagacgtacggacgtcctacgtagttgttactttcgcgtttagtttcgtttttctcgttctacgtcgtagttacgtacgggttacttacgtaaccggtcgaaccgttacggttaccgggaaccggttaacggggaaccgtaagggtaacggtaaacgtaaccggtaaacgtaaccgttgggtacgacgtacgaccgttaaccgtacgttccgttacgttaccttcgttaaccttcccgtaccgtaccc

SEQ ID NO: 106791 - DNA, 720 bp, Homo sapiens
  misc_feature: GYAE6OF01D7XK6.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgctagtctccaggcaccctgtctttgtctccgaggggaaacnccgcccaccctctccgtgtacgggccagtcagaatgtaagcgaccactcctagcctggtaccagacaaaacctggccacgcctcccacggcctcctcactctagtggtcgccgtcccaccgacgggccacgtcggccactccccgagacgtaggttcaggtcggacgtaggttcggggtaccgtggggaacctaggtacctttacgacctcctaccgaccctactacccaacccgtaacggtaccgtacgggaaccgtccgttagtacgttcgtttaacgttttcgacgtttaggttttcgttttttacgtcggttactacggtacttaaggtacgttagggtaaccttccgtaccggtacggtacctacgggttccggaccggtaaggggtaacctaagggtacggtaaaacttaccgaaaacggtaacgttcgggtacggtactacggtaacctacccttacgttaccgttacggttacctttaccgtacccgtttcccgtccccgtaaccg

SEQ ID NO: 106792 - DNA, 618 bp, Homo sapiens
  misc_feature: GYAE6OF01B5R0P.48.71.G05.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagaccaccaccggagaaattgtcgttgacgcagtctccaggcaccctgtctttgctccaggggaacncgccaccctctcctgtacggccaggtcagtaatgttaagngccactccttagcctggtaccagcaaaaacctggccagcctcccaggctcctcatctatggtgcgtccaccagggcccacgtggcactcccagaccaggtcagtggcagtggctgggacagactcactcacaccatccaccgagactaggacgccgtgatgtattttgcgttagttcgtttttcgtggttcaggtctaaggttagtagggtaactttcgaaccgttcggaccgtagttaccgggaccgtacgggggaacctaaggggtacggtaaacttaccggaaaacgaacggttcggtacgggtaccgttacggcctaacccgtaacttaccgtacgtttaccttaccacctttcccgttaccccgtacccg

SEQ ID NO: 106793 - DNA, 720 bp, Homo sapiens
  misc_feature: GYAE6OF01EKRK2.48.71.G05.1.454.CMB.1.raw
  modified_base (202)..(202): a, c, t, g, unknown or other
  misc_feature (202)..(202): n is a, c, g, or t
  modified_base (440)..(440): a, c, t, g, unknown or other
  misc_feature (440)..(440): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctcgagggaacncgccaccctctcctggtacggcctagtcagaatgttaagacgccactccttagcctggtaccagacaaaaacctggaccacgcctcccaggcctcctcactctagtcggtcgccgtccgaccgacgggccctacgtcggacctactcccgagacgtacggttcaggtcggctaggtcgggtcgtgggacctaggtacttcgactctaccgacctataccaccaacgacgtacgggacnccgtagtacttgttatttcgcttaggtttcgtttttcgtcgttacgaacgtcgtaagttacgttacggtaacgtttccgtaacccggttaccgggtaacgtaccggtttaccgggaacccgggtaagggggttaacccgtaaaggggttacggtaaaaccgttaaccggtaaaaccggttaaccgttacgggttccgggtaacgtacggtaacccaacccggttaacttccgttaccggtttacctttaccgtaacctttccccggtccccgttaacccg

SEQ ID NO: 106794 - DNA, 711 bp, Homo sapiens
  misc_feature: GYAE6OF01DIUOV.48.71.G05.1.454.CMB.1.raw
  modified_base (248)..(248): a, c, t, g, unknown or other
  misc_feature (248)..(248): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtctttgctccgaggggaacgccgccaccctctcctggtacgggccagtcaagtaatgttaacgngccacttccttagcctacggtaccaagaaccaaaaaccgtggaccacgccctcccgacggcctcctacatcctagtggtcgaccgtaccgaccgaacgggccacgtcggacactacccgagacgaggttaccaggtggcgtaggttcgggtacgtacggggacacgtacttacaccgtcctaccacctactaccaaccgacgtacgtacggacgtaccgtagtagtagttagttttcggactttaggttttcgtttttcgtcgttacgtagtacgtaagttaggttacggtaacgtttacgaacccgttcggtaactccggttaccgggaccgggacggggtaaccgtagggtaacgtaaaacgttaacgaaaaccggtacgttacggtacggtaccttacggaaccctaccgtaagttccgtttcggttacccttacgtacccttacccgttcccgtaaccg

SEQ ID NO: 106795 - DNA, 702 bp, Homo sapiens
  misc_feature: GYAE6OF01DOZGA.48.71.G05.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (417)..(417): a, c, t, g, unknown or other
  misc_feature (417)..(417): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaacncgccaccctctcctgtagggccagtcagaatgttaagngccactccttagcctggtaccagacaaaacctgccagccctccaggcctcctcatctatggtcgccgtccaccgacgggccactcggcactcccgagactaggtacaggtcggcaggtggggtcgtagggactaggtacttcgacttcctcaccataccaccgagtacgtggacncctagtatggtattttagcgttagtttcgtttttagcgttacgtacgtacgtaggttaacgttaggttaacgtttaccgacccgtttacgggtaaccgttacgtttaccgggacccgggttaacgggggtaacccttaacggggggttaaagtaaaaccgttaacggaaaaacccggtaacgttacgggttaaccgggttaccgtacgggtaacccctaaccgttacgttacccgtttacgtttaccccttaagttacccgtttcccgttaacccccgttacccg

SEQ ID NO: 106796 - DNA, 574 bp, Homo sapiens
  misc_feature: GYAE6OF01DX06Q.48.71.G05.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (423)..(423): a, c, t, g, unknown or other
  misc_feature (423)..(423): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactcttagcctgtaccagcaaaactgccagcctccaggctcctcatctatgtncgtccaccaggccactgcatcccanactgtcagtgcagtggtctgggacagacttcgactctcaccatcaccagctggacgccctgatgtattttgctagttcttttctgtcaggtactaggtttanagggtaacgtttcgaaccgttcggaacgtagttccggacccgtaaggggtaaccaagggtaacggtaaataccgaaaacggtacttagggtaccggacttggaccaacccgtattaccgttcgttaccttctacttccccgttcccgtacc

SEQ ID NO: 106797 - DNA, 650 bp, Homo sapiens
  misc_feature: GYAE6OF01DNK76.48.71.G05.1.454.CMB.1.raw
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaaggggaagccgccaccctctcctgtacgggccagtcagtaatgttaagacgccactccttagccgtggtaccagacaaaactcggccacgcctcccaggctcctcactctatggtgccgtccacgacgggccacgtcggcactcccagacaggttcgagtgctaggtcgggtcgtgggacaggtacttcgacctcnccaccactccaccacgcgtggacncctagatcgtagttttgacttagtttcgtttttctcgtacgtagtacgttaaggttagttacgggtaagtttccgaacccgttcggtaccgttaacggttcccgggaccggtaacggggtaaccgtaagggtaacgtaaacgtaaccgaaaaccggtaacgtacggtacggacttacggtccaaccgtattacgttacgttaacctttaaccttccgttccccggtcttaacg

SEQ ID NO: 106798 - DNA, 750 bp, Homo sapiens
  misc_feature: GYAE6OF01DUM0C.48.71.G05.1.454.CMB.1.raw
  modified_base (152)..(152): a, c, t, g, unknown or other
  misc_feature (152)..(152): n is a, c, g, or t
  modified_base (238)..(238): a, c, t, g, unknown or other
  misc_feature (238)..(238): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccgganaaattgtgttgacgcagtctccaggcaccctgtcttgctccgagggaagcgccacctctccgtgtaggccagtcagaatgtaaganccactctacgcctggtaccagacaaaactggccagactccgagcctcctacatctagtcggtcgcgtaccaccgacggccacgtcggcactacccgagtacgtacgttacgaggtcggacgtaggtcgggtacggtacgggaccaaggtacccttcgaacctttccgaccctaacccgtaacttacccgaaaccgtacggtaaccgttaggggtaacccgtaccgtttagggtaacgtttacgggtttaatttttaccgggtaacggttacgtttttttcggtttttacccgtggtttaacccgaggttaaaccttaacgggttaaggtttaaccgggtaaacgtttccctaacccgggttacggtaacccgtacgggtttaaccccggaaccgggtaacgggggtaacctaagggtaacggtaaaacctaccggtaaaacgtcgtaggttaccgggataccgaccgactaagttccttacggttaccctacgtccctccgttccccgtacg

SEQ ID NO: 106799 - DNA, 721 bp, Homo sapiens
  misc_feature: GYAE6OF01DITS2.48.71.G05.1.454.CMB.1.raw
  modified_base (293)..(293): a, c, t, g, unknown or other
  misc_feature (293)..(293): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaaacgccgccaccctctcctgtagggccagtcagaatgttaagagccactccttagcctggtaccagacaaaacctgccagcctccagctcncatctagtggtgccgtccaccgacggccacgtggcactcccagacgagttcaggtcgcaggtggtcgtgggactagtaccttcactcctaccaaccgtactaccaaccaggtaccgtagggtaccgccgttcgtaagttgttaagttttcgaacgtttagggttttcttttttcgtgtaacgtacggtcttaaggttacgttaacgggttaacgtttcccgaaccccggtttacggtacccgttacgggtttacccggggaacccgggtaaacgggggtaaccctaaagggggttaaccggaaaaactttacccgggaaaaccggtaaccggtttacgggttaccgggttacgtacggtaacccaaacccgttagtttccgttcgtttacccgtttaaccttaaccgttttccccgtacccccgttac

SEQ ID NO: 106800 - DNA, 649 bp, Homo sapiens
  misc_feature: GYAE6OF01A6YM4.48.71.G05.1.454.CMB.1.raw
  modified_base (512)..(512): a, c, t, g, unknown or other
  misc_feature (512)..(512): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtcttgtctccgagggaaagcgccaccctctcctgtaggccagtcagaatgttaagagccactccttagcctggtaccagaccaaaaacctggccagccctccgaggctcctcactctagtggtgccgtccaccgagggccctacgtggccagtccccgagacgtacggttcaggtggcgtaggtcgggtacgtcgggactaaggactttacactccgtacaaccgactaccgaaccgtaacgaccgtaggacgtccctagtagttagtattttcgacgtaacggttagttaacttcgtagtcgtaagaccgtagttacgtagggtacnccgttaccaccgttcaaccgttccgtacgtttccggggacggtaacgggaacgtaagggtacggaacgtaacgtaccggtaaaacgtacgtcggtacgcgtacgtacctacgtaccgtacgttcgtacgtttaaccc

SEQ ID NO: 106801 - DNA, 631 bp, Homo sapiens
  misc_feature: GYAE6OF01C0OWJ.48.71.G05.1.454.CMB.1.raw
  modified_base (242)..(242): a, c, t, g, unknown or other
  misc_feature (242)..(242): n is a, c, g, or t
  modified_base (358)..(358): a, c, t, g, unknown or other
  misc_feature (358)..(358): n is a, c, g, or t
  modified_base (409)..(409): a, c, t, g, unknown or other
  misc_feature (409)..(409): n is a, c, g, or t
  modified_base (442)..(442): a, c, t, g, unknown or other
  misc_feature (442)..(442): n is a, c, g, or t
  modified_base (589)..(589): a, c, t, g, unknown or other
  misc_feature (589)..(589): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaaagccgccaccctctcctgtaggccagtcagaatgttaagngccaactccttagcctggtaccagacaaaaacctgccagccctccgaggcctcctcatctatggtcgccgtaccaccgacgggccactcggcactccccagacgagttcgagtgcngtaggtctggggacagaccttcactctcacacgtccaccgagacgtgtacnccgtagtatgtagtttgccttagttcgttttcncgttacaagtctaaggttagtacggtaacgtttccgaaccgttcggaaccttacggttacccggaccgtaacggggaaccgtaagggaaccggttaaacgtaaccgaaaaccgttacggtaggttacggcgttacgccgtaaccgtnttacgttcggttaccttctaacggttccccttccggtaaccc

SEQ ID NO: 106802 - DNA, 648 bp, Homo sapiens
  misc_feature: GYAE6OF01BG246.48.71.G05.1.454.CMB.1.raw
  modified_base (205)..(205): a, c, t, g, unknown or other
  misc_feature (205)..(205): n is a, c, g, or t
  modified_base (268)..(268): a, c, t, g, unknown or other
  misc_feature (268)..(268): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctacgtctggcctcccagtaccaccaccggagaaattgtgttgacgcagtctccaggcaccctgtctttgtctccagggaaancgccaccctctcctgtacgggccagtccagtaatgttagcacctacttagcctaggtaccaanaaagctggccaggcctccagacctcctcatctatgatgctcacgaggccacgtcggcgtcccgctaggttcagtcgccgtagtcggtctggacagcttcgactctcgactacgtcacgcacgtcctagacgtacccgtaagttacgttttcggtacgttttacgtaacgttcgtacctaaggtccaggtcccgtacggtaccctaacggttccggtacccttaccgtaccggtaaccggtttccggggaccggtaaccggggtaaccgtaacggggttacggaacccttaacgtaaccgtaaaccgtaacggtcgttaagggcccttacgaccacctagtccgttcgttcctactaccgtccctttcccgcgtcttaccg

SEQ ID NO: 106803 - DNA, 809 bp, Homo sapiens
  misc_feature: GYAE6OF01AYZ01.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccgaccggagaaattgtgttgacgcagtcctccaggcctaccctgttctttacgtcctaccgaagggggaacgccgccctaccctctccgtggtacgggcctagtcagaagtagttaagacgcctacttccttacgccgtacggtaaccagaacctaaaaaccgtcggacccacgccctcccgaacggccttaccctactacttccgtagttcgggtcgtccgtcccgaccggtacgggacccacgtccggtaccaccgtaccccgaaggaaccgttaggttaccgagggtacggacgtacgggtcgggttcggtacggggaactacgtactttaccgacttaccgtacccaacctacgtacccaaccgtacggtaccgttacggaaccgtaccgtagtacgttacggtttagtttcgtacgtttaagttttcggtttttaccgtcttaacgtacgtacgttaaggttacgtacggttaaccgttccgtaacccggttacgtaccgttacgggttacccggacgggttaaccggggaacgttaacgggtaacggtaaaccgtaaccggtaaacgtacgggttacgggtacggtaccgacgtaccccgtaacgttaccgtttccgtacgtttaccttacccgtaccgtttccccgttacccgtaccgg

SEQ ID NO: 106804 - DNA, 830 bp, Homo sapiens
  misc_feature: GYAE6OF01AO9WT.48.71.G05.1.454.CMB.1.raw
  modified_base (235)..(235): a, c, t, g, unknown or other
  misc_feature (235)..(235): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccgaggcaccctgtcttgctccgagggaagcgccacctctcctgtaggccagtcagaatgtaagngccactccttagcctggtaccagacaaaaaccgtcggaccacgccctcccgacggctacccgtcactctagtcggtgccgtcccaccgacggcctacgtcggacctactcccgaagtaccgtacggttccgaaggttcgggaccgtagggttacggggttaccgtagggggtaacccgaacggttacccgtttacctacccgttacctacccgtaaccctaacgttaccccgtaaaccccgaaaggtacccgttaggggaacccggaccccgtttaaggtaacgtttacggtttacgtttttacgggtaacctttaacgggttttttcggttttttaccgtacgggtttaccgaaaccggtttacgtacgggtttaaacggttacgggttaaaccgtttaccccgtaaccccggttaacgggtaacccggttacgggtttaccgggaacccgggtacgggggtaaacctaaagggggttacgaaaccgttaaccggaaaaccggttaacgtacgggtaccgtaccgttacggaccctaaccgtaccgtttcttaccgggtttacttaccgtcccgtttcccgtttcccgaacccg

SEQ ID NO: 106805 - DNA, 598 bp, Homo sapiens
  misc_feature: GYAE6OF01EOIYY.48.71.G05.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (302)..(302): a, c, t, g, unknown or other
  misc_feature (302)..(302): n is a, c, g, or t
  modified_base (444)..(444): a, c, t, g, unknown or other
  misc_feature (444)..(444): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaancgccaccctctcctgtaggccagtcagaatgttaagngccactccttagcctggtaccagacaaaacctggccagcctcccaggctcctcatctatggtcnccgtccaccgagggccacgtcggcactcccgagtacaggttcaggtcggacaggtcgggtcgtggggacagtacttcacgtcgtcacctactacaccagacgtcggactccgtagattgtattttcgtctttagttttttcngttactgtactagttagtggtaacgttccgacgtcggactcgtccgggaccgtagggtactaagggtacgaactaccgaaacgtacgtgtcggtctagacctacctagttccgttacgttccgttactaccgttcccgttacccgccgttaacg

SEQ ID NO: 106806 - DNA, 732 bp, Homo sapiens
  misc_feature: GYAE6OF01APF1M.48.71.G05.1.454.CMB.1.raw
  modified_base (204)..(204): a, c, t, g, unknown or other
  misc_feature (204)..(204): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaacnccgcccaccctctcctgtacgggccagtcagtaatgttaagagccactccttagcctggtaccagaccaaaaacctcggccacgccctccaggcctcctcatctatggtcgccgtcccaccgacgggtcccacgtcggccacgtccccagaccgtaggttcctaggtcggccgtaggtcgggtcgtagggaactacggtacttaccaccgtctaccacctactccaaccgtacgtactacggacgtccgtagtagttacgttagttttcgacgttaggtttctttttccgtacgttacgtacgtacggtaacgtttagttacgggtaaacgtttcccgtaacccggttaccgggtaaccgttaccggttcccggggtaaccggaaccgggggttaacccggtaaagggtacggtaaaaccgtacgtaaaaacccggtacggttacggtacggtaccgttacggacccttaaccgtacgtttaccgttcgttttaccgtttaacctcccgtttaccccgtacgttaccg

SEQ ID NO: 106807 - DNA, 830 bp, Homo sapiens
  misc_feature: GYAE6OF01CI394.48.71.G05.1.454.CMB.1.raw
tcagagtatacatacacgaccggtgctcgatttagtgtcgtcgcaagagagaggggggaagagctgctcagttaggacccagagggaaccatcggaaaccccagcgcagcttctcttcctcctgctactctggctcccagacaccaccggagaaattgtgttgacgcagtctccgaggccaccctgttctttcgtcctccgaggggaaacgccgccaccctctcctggtacggccagtcaagtaatggttaagacgcctacttccgttacgccgtaggtaccaagaaccaaaaacccgtcggacccgacgcccctacccgacggtcctccctcgacttcgtagtcggtcgtccgtcccaccgacgggcccacgtacggcacctcccgagacgtacggtcgaggtaggcgtggtcgggtacgacggactacgtaccttcaccgtctaccgacctactacccgaccgacggtacgacgggtaacgtccgttaggtacgttacgtttacgtttttacggccgtttaacggttttttccggtttttacgtaccgtttacccggtaacggttacccgttaaagggttttaacggtttacggggttaaacccgtttacccgttaacccggttacccggttaacgtttaaacccgggttcccggggttaaaccccggggaacgggggtaaacccggtaagggttaacgtaaaaacggtaacccggtaaaaacggtaccggttagggtaccggtacgttaacggttaccccgtaacccgtagtttcccggttaaccggtttccttaacccgttaccgttcccccggttacccgtaccg

SEQ ID NO: 106808 - DNA, 722 bp, Homo sapiens
  misc_feature: GYAE6OF01B68MV.48.71.G05.1.454.CMB.1.raw
  modified_base (207)..(207): a, c, t, g, unknown or other
  misc_feature (207)..(207): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtcctccaggccaccctgtctttgtctccgaggggaacnccgcccaccctctcctgtacggccagtcagaatgttaagacgccactccttagcctggtaccagacaaaacctggccacgccctacccgacgtcctcctcactctagtcggtcgccgtacccaccgacgggcccacgtcggcacgtcccaaggacgtacggttacgacggttcggacgtaggtcgggtacgtcgggacacggtaccttaccgaccttcctaccgaacctactacccgaacccgtaacggtaccgttacgggacgtaccgttagtacgtttacggtttaacgttttcggtaccgtttaggtttttcgtttttcgtacgttccgtagtaccgtaggttacgttacggttaacgtttccgtaaccgttaccggtacgttaccgggttaccggaccggtaacggggtaccggtaaggtaacggtaaactaaccgaaacgtacgtaggtcgtactacggacctaacgtagttccgttacgttccttacctacttcccgttacccgtaccg

SEQ ID NO: 106809 - DNA, 598 bp, Homo sapiens
  misc_feature: GYAE6OF01BNT97.48.71.G05.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (315)..(315): a, c, t, g, unknown or other
  misc_feature (315)..(315): n is a, c, g, or t
  modified_base (445)..(445): a, c, t, g, unknown or other
  misc_feature (445)..(445): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccgganaaattgtgttgacgcagtctccaggcacctgtctttgctcgaggggaancgccaccctncctggtaggccagtcagaatgttaagacgccactccttagcctggtaccagacaaaaacctggaccacgcctccaggcctcctcactctatggtcgcgtccaccncgggccacgtggcactcccgagtacgaggttcaggtcggctaggtgggtctagggacagacgttcactctcgaccataccacagtctagggactacctgacttgtacttttcgctaagtttcgtttttcnggttcagtctaggtacttaggaactttcacgtcggactacgttcgaccgtacgggacaaggtcgaaagtaccgtaaaacgacttcgggtagtacgtacggcaacccgtagttacccgttacgttacctacctactttcccgtcccgtaacccg

SEQ ID NO: 106810 - DNA, 764 bp, Homo sapiens
  misc_feature: GYAE6OF01D2ADT.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaattgtgttagacgcagtctcacggctacctgttcttgtctaccgaggggaacnccgccaccctctcgtggtacggccagtcaagtatagtaacgacgacctacctcgttacgccgtacggtaccaacgaacctaaaaccgtcgacctacgccctccgacgtcctcctactaactctacgttggtcgtaccgtacccgaccggtacggaccctaccggtggacctaccgtaccccgaagtacggtacggtacgaggtcggacgtacgggtcgggtacgtagggaactacgttaacgtcctacgtacctaccaacgttacaccgacctaagtccgtacggtaacgtcgtaggtacgttacgtttagttcgtaagtttcggtttacgtttacgtcgtacgtaggtcttaagggttaactacggtttacgtacctaaccggttccggtaacggttaccgttacccggggaaccggtaaggggtaacccgtaaacggggttaaacggaaaacctaacgggtaaacccggttacggtagggtacccggacttaccaacgtacccgttagttaccgttcgtttaacccgttacgtacccgtttcccgtacccggtaac

SEQ ID NO: 106811 - DNA, 790 bp, Homo sapiens
  misc_feature: GYAE6OF01A83OI.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaattgtgttgacgcagtctccaggccaccctgtctttgtctccgaggggaaacgccgccaccctctccgtggtacgggccagtcagtaatgttaagcgcctactccttacgcctaggtaccagaccaaaaaccgtcggccacgccctacccgacggcctccctactacttcgtagtcggtcgccgtcccgaccgacgggccacgtcggcactcccagacgtaggttcaggtcggcgtagggtcggtcgtacgggacacgtaccttcaccgtcctaccgaccctaatacccaaccgtaacggtacgtacgggtaccgtacccgttaggtaattacggttatttttacggaccggttttagtttttccggttttttccgttacggttaccgtacggttacgtaacggtttaaggtacgggttaaaccgtttcccgaacccggttacgggttaaccgttcgggttaccggggtacccggtaaacggggggttaacccgtaaaggggttacggtaaaaccgtaaaccggtaaaaccgggtaacgttcgggttaaccgggacccttacggacccgttaacgttaccgttccggtttacttacccgtttaacccggttaccctttccccggtcccgttaaccccg

SEQ ID NO: 106812 - DNA, 684 bp, Homo sapiens
  misc_feature: GYAE6OF01D41F6.48.71.G05.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccagcaccctgtctttgtctccgagggaancgccacctctctgtaggccagtcanatgtaagngcactctagcctgtacagacaaacgtgaccacgccctcccaggcctcctcacttctagtggtcgccgtaccaccgacgggccacgtggcctacgtacccgaagtacgtacggttacgaggtcggacgaggtcgggtcgtgggtaactagtaccttacgacctcgtaccaccgactccacgtacgaccgtggacgtcctagtagttcgttagttttcgacgttagttttcggtttttacgtcggtactagtcgtaagttacgtaggtaaccgtttcgaccgttacggacgttacggttcccgggaaccggtaacggggtaactaaaggggttacgtaaaacgtaaccgtaaaaccggtaacgtttgggtaccggttagtaccgaccgtaaccgtaaatttcccggtacgtttacccttaccgttacgtttcccccgttacccggtaacccg

SEQ ID NO: 106813 - DNA, 777 bp, Homo sapiens
  misc_feature: GYAE6OF01CZ6LP.48.71.G05.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaacccagcgcagcttctcttcctcctgctactctggctccagacaccaccggagaattgtgttgacgcagtctcagcacctgtctttgctcgagggaancgccacctntcctgtacggccagtcagaatgttaagcgccacttccgttaagccgttaggaacccaagaccgaaaaaccgtcggaccgacgacccgtcccgaacggtccttcctactacttacgttacgttggttacgccgtacccaccgacggtccacgtcggactaccgtacccgaagtaccgtacggtacgtacggtggtaccgtaaggtcggggtcgtaggggaacctacggtacctttacacgttaccgtaccaaccgtaacgtacccgaaccgtacggttaccgtaacgggacgtacccggttagtaacgttacggttaacgtttttacggacccgtttaaggtttttcggttttacgtacggttacgaacggtacctagggtttacgtaaggttaaccgttcgtaaccgtacggtaccgtacgggttccggaaccggtacggggtaacccaagggttaccggtaaataacccggtaaaacgtacgttacgggtacggtacctacgggtaccctaaccggtactttaaccggttccgttaaccgttacgtacccgtttacccgtcccgtttaaaccg

SEQ ID NO: 106814 - DNA, 777 bp, Homo sapiens
  misc_feature: GYAE6OF01BI8DJ.48.71.G05.1.454.CMB.1.raw
  modified_base (729)..(729): a, c, t, g, unknown or other
  misc_feature (729)..(729): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctccagacaccaccggagaaattgtgttgacgcagtctccgaggccaccctgttctttgtctccgaaggggaaacgccgccctaccccttctccgtggtacgggccagtcagtaactaggttaaagcgtacctaccgtccttagcccgttacgggtaccaacgaaccaaaaaaccgtcggaccgacgaccctcccgacggtcctcctctatcctagtggtcgaccgtccaccgtacggccacgtggcactcccagacgtacggttcgaggtcggacgtaggttcggggtcggtacgggtaccacgtaccgttccacgttaccaccaacctactaccgaccgaacgtaccgtcgggacctaccggtagtacgttaggtttctttacgacgttttaggttttacgttttccgtacggtttacgaacgttagtacgttacggttaacgggttaacgtttacccgttaacccggtcgggtaaaccgttcgttaacccggggtacccgggtaacggggtaacccggtaaaggggttaacgaaacgttaaccgaaaaaccggttacgttacgggtacgtaccgttacgtaccgtaaccccgtntttaccgttaccgttacgtttacccttacgttcccccgttcccgtacg

SEQ ID NO: 106815 - DNA, 682 bp, Homo sapiens
  misc_feature: GYAE6OF01D39PO.48.71.G05.1.454.CMB.1.raw
  modified_base (200)..(200): a, c, t, g, unknown or other
  misc_feature (200)..(200): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtcttgtctcgagggaancgccacctctcctgtacggccagcagaatgttaagagccactccttagcctggtaccagacaaaacctgccacgcctcccaggcctcctacatctattggtcgccgtaccaccgacggccacgtcggcactcccagtacgtcggtcaggtggctggttcgggtcggtaggacagtaccgttccacgtctaccgacccagtaccaacgacgtacgtgggacgtcctaggtatagttacttttcggactttaggttttccgtttttactcggttacctacgtacgtaacggttaacgttacgggttaaccgttcccgtaaccgttacgggtacgttacggttcccgggaacccgggtacgggtaaccggtaagggttaccgtaaaacgtacggaaaaccggtaggttacggtacggtccttacggtaccaaccgttcgttaccgttacgttaccttaccgttacccttcccgtccccggtaccg

SEQ ID NO: 106816 - DNA, 1080 bp, Homo sapiens
  misc_feature: GYAE6OF01CVU8H.48.71.G05.1.454.CMB.1.raw
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
tcagagtatacatacacgaccggtgctcgatttagtgtcgtcgcaagagagaggggggaagagctgctcagttaggacccagagggaaccatcggaaaccccagcgcagcttctcttcctcctgctactctggctcccagacaccaccggagaattgtgttgacgcagtctccaggcaccctgtcttgtctccgaggggaaacnccgcccaccctcctcctggtacggaccagtcgaagtaatgttaacgacncctacctccttagccgtacggtaccagaaccaaaaccgtcggacccacgtcccctacccgaggccttccctactacgttcctacgtcgggtcgtccggtacccgacccggaaccggggccctaaccgtcgggacctaccgtacccccgtaggtacccgtacggttcaagggttccgggtacgtacggggttccggggtaacggtacggggaaacccttacgggttaacccttttaccgtaacccttacccgtaccctaaacccgttaaccgtacccgaaaaccccggttcgggtaaacccggttaccgggggtaacccgttcccggttacgggtttaaacgttttccgggtttaaacggttttttaccggtaaccggtttttaacggggtttttcccggttttttttaaccggtaccgggtttaaccgttaccggttaacgttaaaccggtttaacgggttttaaaccgggttaaccgttttaaccccggttaaccccggtttaaccgggggtttaacctttaaccccggggttttacccgggggaaaccccggggttaaaaccgggggggggttaaaaccccccgggttaaagggggtaaaaacccgggtttaaaaaccccggttaaaaccccgggttaaaaaaccgggttaaacccgggggtttccggggttaaacccgggttaccccggtttaaaccgggttaaacccccgggttaaacccgtttaacccggtttaccgggttttaaccccgtttttaccgggtttaaaccccgttttaaccccggtttaacccccccggtttccccccgttaaaccccccggg

SEQ ID NO: 106817 - DNA, 581 bp, Homo sapiens
  misc_feature: GYAE6OF01A1Z8H.48.71.G05.1.454.CMB.1.raw
  modified_base (203)..(203): a, c, t, g, unknown or other
  misc_feature (203)..(203): n is a, c, g, or t
  modified_base (380)..(380): a, c, t, g, unknown or other
  misc_feature (380)..(380): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgccgtccaccgaggcccactggcatccccagacaggttcagtggcaggtgggtctgggacagacttcactctcaccnctcaccagactggagcctgatgtactttgctagttgttttctgtcacgtcagtatggtaacttcgaccgttcggactacggttccggaccggtacgggggacctaagggtacgaaacgtacgaaaaccgtaacgtacggtacggtctacggaccctaccgtacgttcgttcgttaccttacgtccttccttccccggtacc

SEQ ID NO: 106818 - DNA, 672 bp, Homo sapiens
  misc_feature: GYAE6OF01AW9CL.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaattgtgttgacgcagtctccaggcaccctgtctttgtctccgaggggaaanccgccaccctctcctgtaggccagtcagatgtaagagccactctagcctggtaccagacaaaacctgccagcctccaggctcctcactctagtggtgccgtccaccgaggccactcggcactcccagactaggttcagtcggctaggtgggtcgtagggacagtacttcactcgtaccaccactccaaccagtaccgtgggactcccgtagtacgttggtacttttacggacgtttaggttttcgtttttcgtggttccgtaggtacctaaggttacgtagggtaaccgtttaccaacccggttaccggacgttaccggtttccgggacccggtaacgggggtaaccgtaacggggtaacggtaaaaccgtaaccgtaaaaccggttaacggttgggtaccggtacgtacggaccgtaaccgtgtaccgtttcgttacctttccgtacccttcccgttaccccgtaccg

SEQ ID NO: 106819 - DNA, 686 bp, Homo sapiens
  misc_feature: GYAE6OF01EUOX3.48.71.G05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgctccgaggggaancgccaccctctcctgtagggccagtcagaatgtaagngccactccttagcctggtaccagacaaaacctggaccagcctcccgaggcctcctcactctagttggtcgccgtccgaccgtaggggcccacgtcggcactcccagacgtaggttcaggtcggcgtaggtgggtcgtggggacctagtaccttctactcgtaccaaccatccaaccgacgtacgtgggacgtccgtagacgttgttattttcgcttaggtttctttttcgtgttacgagtcgtaggttagttacgggtaacggttcctaccgttacggtaccgtacgggtttacccggacccgggtaaggggaacccggtaaagggtaacggtaaaacgttaacgaaaaccggtaacgttacgggttacgggacgttacggacccgtaaccgttattaccggtttcgttaccgttttacctaccggtttcccgttccccgtaaccg

SEQ ID NO: 106820 - DNA, 724 bp, Homo sapiens
  misc_feature: GYAE6OF01A1CHW.48.71.G05.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctcaggcacctgtcttgctcgagggaancgccacctctcctgtacggccagtcagaatggttaanacgccactaccttagccgttacggtaccacgacaaaaaccgtggaccacgccctacccgacggtcctccgtacacttacgtaagtcgggtacgccgttacccgaaccgacgggcctacgtcggactaccgtcccgaagtaccgtaggttacgaggtcggaccgtaggtggggtcgtaggggaacctaggtacctttacgacctcgtaccaacctataccaaccgacgtacgtcggactccgtagtactagttactttcggattacgttttacgttttcgagttacgtacggtactaacggttagtacggtaaccgttccgaaccggttccggttaacgtaccgggttccgggaacccgggtaacggggtaaccgtaagggtaacgggtaaaaccgtaacggtaaaaccggtacggtcgggttacggtacgtacggaaccctacgtacgttacgttacgttaccttacttacgttccccgtacccgtaccg

SEQ ID NO: 106821 - DNA, 684 bp, Homo sapiens
  misc_feature: GYAE6OF01BL59V.48.71.G05.1.454.CMB.1.raw
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
  modified_base (512)..(512): a, c, t, g, unknown or other
  misc_feature (512)..(512): n is a, c, g, or t
  modified_base (617)..(617): a, c, t, g, unknown or other
  misc_feature (617)..(617): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccgagggaagcgcccaccctctccgtggtacgggccagtcaagtaatggttaaagacgccctacttccttagcccttaggtaccaagaaccaaaaaacccgtcggacccacgcccctacccgaggtcctcccgttacacgttccgttagtcgggttcgcccgtacccaccggaccgggacccacggtcggacctaccgtaccccgaaggtaccgtaggttcgaggtcgacgtggtcggtcgagggacagtctctactcacacacnccacgtagcgtggacncgtagtgttacgttgttcgtagtttgtttcgtttatcgtnagtgtagtacgtacgtactcgtaccgtacgtacgtcggtcccggaacggtacgggtaacgtaaggaaaccgtaaccgtaacgtaaacggtcggttagtccggtanaccggttcccaccgttgttcccgtttccgttaccttcccgttaacccgttcccgacccgttaacccg

SEQ ID NO: 106822 - DNA, 726 bp, Homo sapiens
  misc_feature: GYAE6OF01BJ7FG.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtcttgtctcgagggaaagccgccacctctccgtggtacgggccagtcagaattgtaagcgcctactccttacgccgtacggtaaccaagaacctaaaaacccgtcggacccacgccctaccgtacggtcctcctacatctagtcggtcgccgtaccaccgcggccacgtcggccaactcccgaagtacgtacggttcgacggtggcgtaggtcgggtacggtacggaacgtacgtaccttcctaactccgtacaacctactaccaaccgtaggtacgtacggaccgtccgttacgtagttacgttagtttacgtaccgtttaaggttttcgttttccgtacgtttacgacgttaccgtaaggttacgtagggttaaccttccggtaccgtacgggtaacctacgggtttaccggaaccgggtaacggggtaaccgtaacgggtaaggtaaaacgtaaccggtaaacggtaacggtcggttacggacttacggaaccgtaaccctgttacccgttgtaccttacctacggttcccctccgtacg

SEQ ID NO: 106823 - DNA, 713 bp, Homo sapiens
  misc_feature: GYAE6OF01CD1O9.48.71.G05.1.454.CMB.1.raw
  modified_base (659)..(659): a, c, t, g, unknown or other
  misc_feature (659)..(659): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccacccctgttctttgtctccgaggggaacgcgcccaccctctcctgtacggccagtcagaattgttaagcgccactccttagccgttaggaccagaccaaaaacctcggaccacgcctcccgacggcctccgtctactcttagtggtcgtccgtacccgaccgtacgggcccacgtggcacttccccgagacgaggttccgagtcgggactaggtcgggtcggtggggaccagttacctacgtacctactaccacccgtataccctacccgacgtaccgtacgggacgtacccgtagtacgttggtttacgtttcgtacgttacggtttcggttttttactcggttacgtacggttacgtaaggttacgttacggtacggtttacccgtccggtaccgtacggtacgttaccgggaccggacggggtaaccggtaaggttaacgggtaaagtaccgaaaccgttacgtagggtccggttacncggccaccgttactccgttcggttacctccttacgttccccgttccccgtaccg

SEQ ID NO: 106824 - DNA, 793 bp, Homo sapiens
  misc_feature: GYAE6OF01ELQO4.48.71.G05.1.454.CMB.1.raw
  modified_base (487)..(487): a, c, t, g, unknown or other
  misc_feature (487)..(487): n is a, c, g, or t
  modified_base (520)..(520): a, c, t, g, unknown or other
  misc_feature (520)..(520): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccacccttgttctttcgctccggagggaaactcgaccctaccctctcctggtacggccagtcagaagttgttagccacctacgttagccttaggtaaaccaaacgaaaacgtcccgtagggaccctaacgggtcctacccgaagtaccctcctacactacctagtcgacttcgccgtactaccggacgggccctaacggtccggggacccgttcccggactacggtttccacggtcggacccgtagggtcggggtcgtaggggacctaggtccttacgactccttaccaaccgtacacgaacgtccgtacncccggttaagaacccggtacccgtaaacggttnttttacggtacgggttttactaccgttacgtactacgggccgtaagtcccggtagtacccctaacggttccgtacccttaccggtcccgtaccggggttaccgggtaccgggaaccggggtaaaccccgtaagggttacgggaactaaccggttaaccgaaaaacccggtagttaccgggtacggttaccggtacgtacccggaaaccttgttacccggtaactttcccggttacccttaacttccccgttaccccgttccgaatttacccgg

SEQ ID NO: 106825 - DNA, 579 bp, Homo sapiens
  misc_feature: GYAE6OF01BJG5B.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngccactccttagcctggtaccagcaaaaacctggccagcctcccaggctcctcatctatggtgcgtccaccgagggccactggcactcccgagacgaggttcagtggcaggtggtcgtgggacagtacttcgactctacaccatccaccagactcggagccctgattgtatttgcttagtttcgttttctgttcagtctagttacgtggtaacgttccaccgtcggactacgttccggaccgtaaggggaccgtaagggtacgaaacgtacgaaaacggtacgtggtacggtctacgccacctactcgtacgttcttacaccttcccgtcccgtaccg

SEQ ID NO: 106826 - DNA, 879 bp, Homo sapiens
  misc_feature: GYAE6OF01CKW6U.48.71.G05.1.454.CMB.1.raw
  modified_base (369)..(369): a, c, t, g, unknown or other
  misc_feature (369)..(369): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctcaggcaccctgtctttgtctccgagggaacgcgcccaccctctccgtgtacggccagtcagaatagttagacgccacttcctagcctggtaaccagacaaaaccgtcgaccacgccctcccgaggccttcctacactcgtatcggtcgccgtaccgaccggacggccacgtcggcacgtcccagaccgtaggttacnggtggccgtaggttcggggttacgtcggggtacacggtacctttcgaccgttaccctacctacccaacgttcccaaacccggtacgtaacccgggttggtaacccggtcccgtaaggtttacgttacggttttaagtttttccggacggtttttaacggttttcggttttttaaccgttggttacccggttaaccgtcggtttaacgggtttaacggttacgggtttaaaccgttttacccggtaaccggttaaccgggtttaaccttacccgggtttaacccggggttaccgggtaaacccggggggtaaaaccggttaacggggttaaaaccgggtaaaaccgttaaaccggtaaaacccggggttaacctttacggggggtaaccggggttaccccggtacggttaaacccccggttaaccccgtttaacccggttttacccgtttaccgtttaccccggttttaacctttaacccccgtttcccgggtttaccccccccttaacgg

SEQ ID NO: 106827 - DNA, 845 bp, Homo sapiens
  misc_feature: GYAE6OF01AF5D0.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaacgccgcccacccgttctcctggtagggccagtcagaatgttaagacgccactccttagccttggtaccagacaaaaacctggccacgcctccacggctcctcactctatggtcgccgtccaccgacggcccacgtcggctaacgtccccaagaccgtacggttcaaggttcggcgtaacggttggggtaccgttacggggaacctaaggtacctttaccaaccgttccgttacccaaaccctacttacccaacccgtaacgtaccgttacggggaaccgtcccggttaggtaacgtttcggtttaaacgtttttgggtacccgtttaacggtttttcggttttttaccgttacgggttaccgtaacgttacgtaacgggtttaacggttacgggtaaaccggttttacccgaacccggttttaccggggtaaaccgttacggtttaacccgggggaacccgggtaaacggggggtaacccgtaaaacgggggttaagggtaaaaacctaccgggaaaaaaccggttaaccggttagggttaccgggtaaccgtttccggaacccgtaaccccttaggtttacccgtttacggtttacccttttacccctacggtttccccctttacccccggggttaacccc

SEQ ID NO: 106828 - DNA, 924 bp, Homo sapiens
  misc_feature: GYAE6OF01CB2RD.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtcctccaggccaccctgtctttcgtctccgagggaaacgccgcccaccctctccgtagtacggccagtcgagtaatagttaaagacgcctacttcccgttaacgcccgtaggtaaccacgaacctaaaaaacccgtcggacccgacgaccccttaccccgaacgggtccttaccctaccgtaacttccgttaacggttcgggttaccggtacccggttacccccgtaacccggaccgggggtaacccccctacggttccggggaacctacccgttacccccgaaacggtaacccgttaacgggtttaccgaaccgggttcggaccggttaacgggttcgggggttaccggttaggggaacccgtaacggttaaccccgtttacctaacccgttacccgtacccaaacccgtaaccttacccgaaaaccgtacgtaaacccggttagggacccggttaccgttacggtaagtttcggtttaacgttttacgcgtttaacggtttttcgttttacgtcggttacgacgttacgtaaggtttacgtacgggttaacttacccgtaccgttcggtaaccgttacggttacccgggtaacccggtaacggggtaacccgggtaacggttaaaccgggtaaaccgttaaacccggaaaaacggttacccggtagggtccggtacccgtaaccggtaacctacccggttaacttacgttaccgttacccgtttaccacccgttccccgtaccccgttaacccg

SEQ ID NO: 106829 - DNA, 845 bp, Homo sapiens
  misc_feature: GYAE6OF01CK8GC.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagccgccaccctctcctgtagggccagtcagaatgtaagagccactcctagcctggtaccagacaaaaacctggaccacgcctcccacggcctcctcatctatggtcgccgtaccaccgacgggcccacgtcggacctactccccgaagtaccgacggttaccgaacggtcggaccgtaggttcggggttaccgtgggggaacctaggtacctttccgaaccttccgtacctaaacccaacgttcccgaacccgtaacggtaaccgtcggggtaaccgccccgttaggtaacgtttacgggttaacgttttttacggaccggttttaaggtttttcgtttttttttacccgtacggtttaccgtaacggtacccgtttaagggtttaaacgtttaacgggttaaaccggtttcccgttaaaccccggtttacccgggtaaccgttaaccgggttttcccggggaacccgggttaaaccggggggtaacccgtaacggggttaaacggtaaaaccgttaaccggaaaaaccgggttaaccggttaacgggttacgggtacccttaccgggaacccttaacccgtaacgtttccgttacccgtttacccgttaccttacccgttcccgtttccccccggtaaccg

SEQ ID NO: 106830 - DNA, 740 bp, Homo sapiens
  misc_feature: GYAE6OF01BKYYG.48.71.G05.1.454.CMB.1.raw
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaagcgccaccctctcctgtagggccagtcagaatgttaagacgcctactccttagcctaggtaccagacaaaaacctcggccacgcctccgagctcctcatctatggtgccgtccacgaggccacgtggcactcccagacgtacgttcgagtcggacgtaggtggtacgtacgggactacgtacttcgaacgtctaccaccctagtacccaaccgaacgtacgttacgggacgtcccgtaggtaacgttcgttaattttcggactttaagggtttttccgttttttcgtagttaccggtacgtaccgtaaggtttaggttacgggttaaaccgtttccgtaaccccggtttggtaaccgttaccggtttccgggaaccggtaaaccgggggtaaccgtaacggggtaaacggtaaactaaacccggttaaaaaccggtacgttagggttcccggtacttccggaaaccgttacccgtagttaccctttaacgggtttcccctttacgttaaccccgtttcccccgttccccggttaaaccc

SEQ ID NO: 106831 - DNA, 941 bp, Homo sapiens
  misc_feature: GYAE6OF01CVXV4.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccacggagaaattgtgttgacgctagtctccaggccacccttgtctttgtctaccggaaggggaacgtccgacccgtacccctctccgtaggtacgggcctagtccaagtaagttaggttaaagaccgcccgtacgttaccttacggaccgtcggtaaccaagaacccgtaaaaacccgtcggaccacgccccgtacccgacggtcccttcctactaacgttacgtaacggttcgggtcggtacccgtacccggtaccgaaccgggggtacccaccggtaccggtaccgtaacccggttaccccggaacggtaaccggtaacgggtttaccgaacgggttacggaaccggttcgggttacggggtaccggtacgggaaccgtaacggttacccttaaccgacctttacccgtaccctaacctaccgtaacccgaccgtaaacggtcgtacggtacgtaccgttagtaacgttcggttacgttttacggtacttttaacgggttttcgttttacgaccgttaccggtacgtaacgtttaggtttaacggtaccggttaaaccggtttacccgtaaccggggtaaccgttacggttaaccggggttaccccgggtaaccgggttaaacggggtaacccggttaacggaaacgggtaaaaacccgttaacggttaaaaaccccggtagggtttccggaaacggttacccgttaacgggacccctttaacggtaaccgttttcgtaaccgggttaccctttacccgttaaacccgtttccccgggttaaccccgttaacccgg

SEQ ID NO: 106832 - DNA, 717 bp, Homo sapiens
  misc_feature: GYAE6OF01BSIDD.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtcctcaggccaccctgttctttgtctccgaggggaagccgcccaccctctccgtgtacgggccagtcagaattgttaagagccactccttagcctggaccagacaaaacctgccagcctcccaggcctcctcattcctagtcggtcgccgtccgaccgacgggcccacgtcggcctactccccaagaccgtacggttaccgagtggaccgtaggtcggggtcgtagggacaacgtccgttcgacctcgtacccaccgtactaccaaccgtagtacgtacgggacctcccgttagacgttcggttaagtttttcggactttaggttttcgttttttacctggttactagtacgtaggtttagttacggtaaccgttcgtaaccgttacggtaaccgttacggtttcccggggaaccggtaaccgggggtaacccgtaagggttaacggaaacttaccgtaaaacggtaacgttgggtaccggaccgttacggaccctaacctaggttcccgttacgttacctaccgttccttccccgtccccgttacccg

SEQ ID NO: 106833 - DNA, 741 bp, Homo sapiens
  misc_feature: GYAE6OF01DIW6Y.48.71.G05.1.454.CMB.1.raw
  modified_base (204)..(204): a, c, t, g, unknown or other
  misc_feature (204)..(204): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctggtacgggccagtcagtaatgttaagacgccacttccgttagccgtggtaccagacctaaaaaccgtggaccacgccctacccgaggcctcctacattctagtcggtcgccgtcccaccgacggccacgtggccactaccagacgtagttcgagtcggcgtaggtgggtcgtacgggacacggtaccttcaccgttacctccgacctaactaccgaaccgaacgtacggtacggacgtccgtagttacgttaggttattttcggcgtttaaggttttcgttttttctacgggttactaggtacttaagggttagttacggttaacgtttccgtaaccgtagggtacccgttagtaccccggggtacggtaaccggggtaaccgtaggggtaaccggttaaaacgtaaccgtaaaaccggtaacgttccgggttacggacccggttacggtaacccgaccgttaagtttcccgttacgtttacccttacctttaacccgttccccgtttaccccggtaacccg

SEQ ID NO: 106834 - DNA, 995 bp, Homo sapiens
  misc_feature: GYAE6OF01BS0BL.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggcctccagacaccgacggataattgtgttgacgctagtcctaccgaggcctaccgttgttctttcgtcgtaccggaaggggaaactccgaccctacccttcttccgtagggtaccgggacctaaggtacaaaggtaaacgttaggttaaaacggacgtaccctaaccgttccgttaacggaccgttacggtaaacccaaacgaaacctaaaaaacccgttcggaaccgtacgtaccccttaccgaacggtacccttaccgtacctaacttaccgttaaggttcggtccggtacccgttaaccccaaccggtacgggtaccctaacggttacggacctaaccgtaccccgaaagtaccgtaacggttacaagggttcggacgtaggttcgggtactacggggaactacgtaccttaccacgttcctaccgaacctacgtaccaaccgtacgtacgtacgggaccgtccgttaagaacgttttacggtttaacgttttacggaaccgttttaggttttttcggtttttttaaccgacgggttaacctaaaggttacggtttaaacgggttaaaggttttaaccggggtttaaacccgttttacccgaaacccgggtttaacggtaaacccgttaaccggggttttaacccggggaacccggttaaaccgggggaaacccggtttaaaaggggtaaacgttaaaaacccgttaaacccgggaaaaacggtttaacccgggttggggtaacccggttaactaaaccccggggtccttaaaaccccggtttaacgttcccggtttttaacgttaaccccggttttaaccttacccggttttaacccccgttccccccggttaaaaccgg

SEQ ID NO: 106835 - DNA, 668 bp, Homo sapiens
  misc_feature: GYAE6OF01CIGCJ.48.71.G05.1.454.CMB.1.raw
  modified_base (408)..(408): a, c, t, g, unknown or other
  misc_feature (408)..(408): n is a, c, g, or t
  modified_base (478)..(478): a, c, t, g, unknown or other
  misc_feature (478)..(478): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
  modified_base (603)..(603): a, c, t, g, unknown or other
  misc_feature (603)..(603): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaattgtgttgacgcagtctccaggccaccctgtctttgtctaccgaggggaaacgccgcccaccctctccgtggtacgggccctaggtacagtaaacgttgttaaagacgaccacttaccttacgccgtggtaacccaagaaccaaaaaaccgtcggacccacgtacccctcccgacggcctaccctctactcgttaagtcggttacgccgtaccaccgacggcccacgtcggaccactcccagacgtaggtacagnggcgtaggtcggtcgtggacagtacctcactctaccaacgtactaccaccgagtaccgaggcgtacgtgntatttacgttagtcgttagtttcgttttacncgttacnggtactaggtgtaggtaaccgttcgtaccgacgtcgtaccgggttcgacgggacggtaacgaggtacggtaactaacggaaaccgtntaggtccgacgtcgacctccgtaagttccgtcgttaacctcttaaccgttcccgttacccgtacg

SEQ ID NO: 106836 - DNA, 854 bp, Homo sapiens
  misc_feature: GYAE6OF01BFQKL.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggcctcccagaccaccaccggagtaattgtgttcgacgcagtctaccgacggcctacccttgtctttcgtccgtaccgaagggggaacgccgaccctaccctcgtccgtcgggtacggcctagtacaacgtattaggtaacgacgacctacttccgttacgccgttacggtaccaacgaacctaaaaccggtcggccacgtcccctacccgacggtcctacctacacttaccgttaggttcgggtaccggtacccgtacccgaccgggtacggtacccgacgtacggacctaccgtaccccgaagtaccggttacggttaccgagggtcggacggttacgggttcgggtacggtacgggtaaccgtacgtaaccgttaccgaccttaccgtaacccaaccgtacctaccgaaccgtagaccgtacggaccgttacgtagttacgttgtttacgtttacgtacgttttcggttttcgttttcgccgttacgtacgtacgttaacggttacggttaacggttacttaccgggtaccgttacgggttaaacccgtgggtacccgggtaaccgggtaacgggtaacggttaaaccgggtagtaaaaccgtaaccggttaaaacccggtacgggttacggtaccggtaccgttacccgacggttaaccgttaaccgtttcgtttaccggttacccgttaaccgtcccgttttcccccgccgggttaacc

SEQ ID NO: 106837 - DNA, 748 bp, Homo sapiens
  misc_feature: GYAE6OF01DIEN8.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaanccgccaccctctcctgtacgggccagtcagaatgttaagacgcctactccttagcctaggtaccagacaaaacctggccagccctcccaggcctcctcatcctagtggtcgccgtaccgaccgacgggcccacgtcggccacgtccccagaccgaggttcgagtcggcgtaggttcgggtcgtcgggactacgtaactttccgaccttctacccacctactaccaaccgagtacgtacggaccgtccttagtaacttcggtttaagtttttcgacgtttaagttttcggtttttacgtcggtacctaggtaccttaggttaagttaacgggttaaccgtttacccgtaaccgttacgggtaaaccttccgggtttacccgggacccgggtaacgggggttaaaccgtaaggggttaacggtaaaaaccgtttaaccgaaaaccgggttaacgttcgggtaacgggtcccgttcggaaacccgtaaccttagttaccgtttcgttaccgttaccgtttaacccgttccccgttacccccggtaacc

SEQ ID NO: 106838 - DNA, 785 bp, Homo sapiens
  misc_feature: GYAE6OF01BNEFY.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttagacgcagtctccaggccaccctgtctttgtctccgagggaacgccgccacctctcctgtacggccagtcagaatagttaagacgccactcctacgccgtaggtaaccacgaaccaaaaccgtcggacctacgtcccctccgacggtcctcctacgtacttacgtacgtcggtccgtaccgttaccccgacccggtaccgggcccctaaccggtccggtacccaaccgtacccccgtaacggtaccggtacggtttaccgagggttacgggaccgttacgggttacggggtaccgtacggggtaacgtacgtaacccgtttaccgtaacccttcgtaccccgtaaaccgtaacgttacccgaaacccgtacggtacccggtacgggtacgtacccgtagtacgttagtttacgtttacggactttaaggttttcgttttccggtagtacgtacgttacttaaggttacgtacgttaacgttccgtaaccgtacggtaccgtacgttacccgggacgttaacgggaactaagggtaacgaactaacgaaacggtacgtggtacgagtacgacccgttaccagttcccgttaggttacccttacgtacgttccccgtcccgttacg

SEQ ID NO: 106839 - DNA, 730 bp, Homo sapiens
  misc_feature: GYAE6OF01E0G7O.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccacctgtctttgtctccgaggggaaagccgccaccctctccgtagtagggccagtcagaatgttaagcgccactcctagcctggtaccagacaaaacctgccacgcctccagcctcctcatctagtcggtcgccgtccaccgacgggcctacgtcgccactcccaagtacgtaggttaccaggtcggcgtaggtcgggtacgtacggggactacggtacttcgtaacctccgtaccacctactaccaaccgtacgaccgtcgggacgtacctagtaagttaggttacttttacggacgtttacggttttacggtttttccgtacggttacacggttacgttaggttaacgttaggtacgtttacccgaccgttaccggacgttaacgggttaccgggacccggttaaagggggtaacccgtaaaggggtaccgtaaaacggtaacccggtaaaacggtaacggttcgggtaacggtacttaaccggaacccgtaaccttaacggttccgtttaacggttcttacccttaccgtttccccgttaccccgtaccg

SEQ ID NO: 106840 - DNA, 854 bp, Homo sapiens
  misc_feature: GYAE6OF01AKF3F.48.71.G05.1.454.CMB.1.raw
  modified_base (207)..(207): a, c, t, g, unknown or other
  misc_feature (207)..(207): n is a, c, g, or t
  modified_base (730)..(730): a, c, t, g, unknown or other
  misc_feature (730)..(730): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggactcccagacaccaccggagtaaacttgtgtgacgcgagtctcaggccaccctgtcttagctaccgaggggaacnccgtccacccctctccgtacggtacgggccctaggttccaagtaactaggtttaacgacgtccctaacgttcccgtttaacggcccgttacggggtaacccaaacggaacccgtaaaaaacccgttccgggaacccgcggtacccccgttacccgtaacgggtcccttccccggttctaacgttcccgttaacgttcgggtttaccggtacccggtttaccccgaaccccgggtaaccgggacccgtacccggtttaccggggtccctaacggtacccccggaaccgggttaaccggttaaccggggtttcccggaacggttacgggtacccgttaagggggtttcccggggttaaccggggtaaccgggggtaaccgtaacggtaacccgtttacggtaccttaccccggtaccctaaacccggtactacccgaaccgtaaccggtaccgttacgggtaaccggtaccgttcgagttacgtacttttcggagttaccgtttgttttacgtacgtactacgtntacgtcgtagggtccttacgccgtacgacgtaccgtccggacgtcgggaccgtaggacgtacgacgacgtacgtcggtcgtactgcccgacgtctacgtcgttactctaccgttcgtccctacg

SEQ ID NO: 106841 - DNA, 838 bp, Homo sapiens
  misc_feature: GYAE6OF01EFIV7.48.71.G05.1.454.CMB.1.raw
tcagagtatacatacacgaccggtgctcgatttagtgtcgtcgcaagagagaggggggaagagatgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagatgttagagccactccttagcctggtaccagacaaaaacctggccagcctcccaggcctcctcactctacgtcgcgtccaccgacggccacgtggccactcccgagacgtacggttacgccttagggcgtacgtagggtactggggtacctaacgggaactttaccgacctaccttccgaaccccaaacgttaccaacccctaagggaacccttacggggtaacggtacccgttacggaacgtttacgggaacttttttagggttacctttaagggtttcgggttttaaacccttttcgggtttacctaagggtacccgtaggttaaacttcgggtaaaacggttttccgtaaacccgtttccgggtaaacccgtaccgttttaaccggggtaccccttaaacgggggggtaaccctaaaacgggggttaacggggaaaaaacggtttaccggaaaaaaccgggttaaaacccgttaaacgggttaacggggtacccgttaacgggtacccgaaaccccggttaacttaaccccgtttaggttaccccgtttttacccgtaacccgtttacccctttttaacccccgggtccccctttaaaacccgg

SEQ ID NO: 106842 - DNA, 597 bp, Homo sapiens
  misc_feature: GYAE6OF01CUBZ0.48.71.G05.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaanccgccaccctntcctgtaggccagtcagaatgttaagagccactccttagcctggtaccagacaaaacctggccagcctcccaggcctcctcatctatggtcgccgtccaccgagggccactggcactcccagacaggttcagtggcagtgggtctgggacagtacttcactctcactatcaccagactggacgtccagatgtattttgctagttgttttctgtcagctagttatcggtaaggtttccaacccgttcggaacctagtttccgggacccaagggggtaccctaagggtacgaaaacgtaccgaaaacggtacgttaggtacggtacttcggcctaaccgtacgttccttaggttacctttaccaacgtttccccttacccggtacc

SEQ ID NO: 106843 - DNA, 813 bp, Homo sapiens
  misc_feature: GYAE6OF01ENH9X.48.71.G05.1.454.CMB.1.raw
  modified_base (768)..(768): a, c, t, g, unknown or other
  misc_feature (768)..(768): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggcctccagacaccaccggagaattgtgtgacgcagtctccaggccaccctgtctttgtcctccggaagggggaacgccgccaccctctcgtcgtacgggccagtacagtaatagttaagaccgacctacctaccttacgtccgtacggtaacccacgaaccgaaaaaccgtcggtaccaccggtccccttaccgacggtcctacctacctactcctaacgttcggtcggaccgtacccgaacggccggggtaccaccgtcggacctaccgtacccgaagtaaccggtagttcgacggtcggtcgtaggtcggggtacggacgggacctagtacctcgctaccgtactacctacgacctacgacgtagcgtacggtacctgtacgttcgttatttacgtacgttacggttttcttttacgtactacggtacgtacggtaagttaccggttaacggggtacctttaccgggtaccgttaaccgggtaacgtcccgggggtttaaccgggacccggggtaaaggggttaaacccgggtaaggggttaaaccggttaaaaccggtaaacggtaaaacccggttgggtacgggtttaaccggtccgtaaccggttaccctacccgttaagtttcccgggtnttttaaccctttacccggaccttttccccggtacccggttaaacc

SEQ ID NO: 106844 - DNA, 722 bp, Homo sapiens
  misc_feature: GYAE6OF01C15S1.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaattgtgttgacgcagtctcagcaccctgttctttgtctccgagggaagccgccacccttctccgtgtacgggcccagtaccaagtaattaggttaacgcgaccctacttccttacgccgtaggtaccagaaccaaaaccgtcggccaacgccctacccgaggcctaccgtcatctacgtggtcgccgtaccacgacggaccacgtcggactaccgaccctaacggactacggttaccgaggtcggtacggtcggtcggggtacgtacggggaacgtacggtaccttccgaccttcccgtacaccgaacttccaacctacggtacgtacgggtacgtaccgttagtacgttagttcgttttgtacgttaggtttttcgtttttacgtcgtcgttaacgtcgtaaggttacgttaggttaccgttactacgtcggtaccgtcgggttacggaccgggtacgggtacggtaacgggtagtaaaaccgtaacgaaaccgttaggtaggtccgacgtccaaaccgtccgtactttacgtcgtttaccgtagtttacccctccgttcccgtaaccg

SEQ ID NO: 106845 - DNA, 763 bp, Homo sapiens
  misc_feature: GYAE6OF01BNQ5M.48.71.G05.1.454.CMB.1.raw
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagcgccaccctctcctgtacgggccagtcagaatgttaagcgccactccttacgcctggtaccagaccaaaaccgtcggccacgccctcccgagcctcctcatctagtcggtcgccgtccaccgcggccacgtcggaccactcccgaagaccgtaggttacaggtcggcgtacggtcggggtcgtcggggaactacgtaaccttccgaccttcctaccaaccctacgtacccaaaccgacggtacccggttagggaccgttcccgttagtaacgtttacgttacgttttcggtactttaacgggtttttcgttttttacgacggtttccgacgttaccgttaaggtttaacggttacggttaaccgtttacccgaccggttaacggtaaccgtacgggtttacccgggaccggtaacgggggtaacccgtaaacgggtaacgggtaaacgtaaccggtaaaaccggtaacgttcggggtacgttacccgtacggtaccccgtaactaacgtttccggtaacgttcctttaacgacccgtttccccgttaccccggtaacc

SEQ ID NO: 106846 - DNA, 767 bp, Homo sapiens
  misc_feature: GYAE6OF01A7DBL.48.71.G05.1.454.CMB.1.raw
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaaacnccgcccaccctctccgtgtacgggccagtcagaatgttaagancctactccttagcctggaccagcaaaaacctcggccagccctcccgaggcctcctctatctattggtcgccgtccctaccgagggccacgttgggccactcccaagaccgtacggttcgacggtgggctaggtcggggttcgtaggggaccgtacggtacttcccgacttccgtacccaacccgacttaccaccgtaacgtacgtacggacgtacccttagacggttcgttaacggttttcgacgtttacggtttttacggtttttcgttaccggttaccgtaggtaccgttaaggttacgttacgggtaaccggtttaccgtaaccccgttaccgggtaacccgtttaacgggtttcccggggtaacccgggaaccgggggttaaacccgtaaaggggtttacgggaaaaccgttaacgtaaaacccggtaccgttacgggtacggtcccgttacgaccgtaacccgtcgttaccgttcgttactttaacccgcctttaccgttcccccggtaaccg

SEQ ID NO: 106847 - DNA, 780 bp, Homo sapiens
  misc_feature: GYAE6OF01E52JF.48.71.G05.1.454.CMB.1.raw
  modified_base (775)..(775): a, c, t, g, unknown or other
  misc_feature (775)..(775): n is a, c, g, or t
tcagagtatacatacacgaccggtgctcgatttagtgtcgtcgcaagagagaggggggaagagctgctcagttaggacccagagggaaccatggaaaccccagcgcagtcttctcttcctcctgctactcgtcggctcccgagaccaccgaccggagtaaattcgtgttcgacgcacgtcctaccgacgcctaccctgttcctttcgtcctaccggtaaggggaaccgccgtcccacccttcgtccgtacggtacggaccctagtacaagtaacgtacggtaagacctacctaccgttaccttacgtccgtacggtaccacggaaccaaacccgtcggacctaccgccctaccgacgtcctcccgtacacgttctacgttcggtaccgtccgtacccgacccggacggtcctaccgtaccggaccctacgtacccgaagggttacccgtacgggtacgtacgggtcgacggttgggtcggtacggtacgggtaaccgtacgttaccttacccgtaccgttacctaacccaccgaactacccgaactacggtaccggtacggtacctccgttaggtattacgtttagttccgggtacttttaggttttccttccgtaggtacgtacgtacggtaaggttcgttaacggttcgtacccgtcgtaacggtaccgtcggtacgcggaacgggtactacgggtatacgttaaccggacgtccgtagtccgaacgtaccgtccctaacgtcttccgtacttcctaccgccttaaccccggnttaac

SEQ ID NO: 106848 - DNA, 593 bp, Homo sapiens
  misc_feature: GYAE6OF01EUCQN.48.71.G05.1.454.CMB.1.raw
  modified_base (199)..(199): a, c, t, g, unknown or other
  misc_feature (199)..(199): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctccagacaccacggagaattgtgttgacgcagtctccagcaccctgttctttgtctcgagggaacncgccaccctctctgagggccagtcagaattagtaagacaccactccttagcctgtacacacaaaacctgccacgccctacccgaggcctcctacactctagtggtagccgtccaccgacggccacgtgcactccagtactagtcgagtcggctagtggtcgtagggactagacttcacttctacacctatccgacgacgtactggactcgtagtattagttntttacgngttgtttattttccgtgttacagtacgtacgttaattcgggtaattccgtaccgtacggtacgtacgttaccgggactaacggggaacgtaaggtagaaacgtaacgtaaacgtacggtgtacggtgacgcacgtattcgtcgttactacctcttcctcccgtac

SEQ ID NO: 106849 - DNA, 715 bp, Homo sapiens
  misc_feature: GYAE6OF01DN900.48.71.G05.1.454.CMB.1.raw
  modified_base (204)..(204): a, c, t, g, unknown or other
  misc_feature (204)..(204): n is a, c, g, or t
  modified_base (671)..(671): a, c, t, g, unknown or other
  misc_feature (671)..(671): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagtaaattgtgttgacgcagtcctccaggcaccctgtctttgtctcgaggggaanccgccaccctctcctgtagggccagtcaagaatgttaagacgccacttccttagcctggtaccaagaacaaaaaccgtggaccacgccctcccaggcctcctcatcctagtggtcgtccgtaccgaccgacgggacccacgtcggctacctacccgaagaccgtacggttacacggttcggcgtaggttggggtcgtagggacctaaggtaccttccacttcctaccacctataccaccaacggtacgcggtaccgccgtagaacgttacgttaacgttttgtacgttaggttttcggtttttaccttacggttccgtacggtacgttaaggtttaacgtcgggttaaacgttccttaacccgttcgggtaacctacggtttcccgggacccggtaaacggggaaccgtaagggtaacggtaaaacctacggtaaaccggtaacgtggtacggtacttaggaacccncgttaacgtcgtttgtaccctttacaccttcccgtcccgtaccc

SEQ ID NO: 106850 - DNA, 879 bp, Homo sapiens
  misc_feature: GYAE6OF01C0EQY.48.71.G05.1.454.CMB.1.raw
  modified_base (151)..(151): a, c, t, g, unknown or other
  misc_feature (151)..(151): n is a, c, g, or t
  modified_base (179)..(179): a, c, t, g, unknown or other
  misc_feature (179)..(179): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccgganaaattgtgttgacgcagtctccaggccnccctgtctttgctccgaggggaagccgaccaccctctccgtggtagggccagtcagtaatgttaagacgccactctagccgtagtaccagaacctaaaaccgtcggaccacgtccctacccaggtcctcctcactcgtagtcggtcgtaccgtaccgaccgacggcctaccgtcggtaccaccgtacccgacggtaacgtacgggttaccgaaggtcggtaccgtagggttaccgggtccggtacggggtaacctacggtacctttaccgaaccttcctacctaacccgtacgtaacccaacccggtaagtacggttaacgggtacccgtaccggttacggtaacgtttacggtttacggtttttccgtaccggttttaacggttttttccggtttttccggttacggttaaccgaccggttacggtttaaggtttaacgggttaaccgggtttaacccgttttacccgtaaccccggttacgggtaaacccgtttaccggggttacccgggaacccggggttaaccggggtaacccggttaaagggtaaaccggtaaaacccgggttaaacggtaaaaacccgggttcgggttaccgggtaacgggttaccggtaccgttaaacccgtaacccgtttaccggttaccgtttacccggttaactttacccttacccgtttccccgtcccccggttaaccg

SEQ ID NO: 106851 - DNA, 748 bp, Homo sapiens
  misc_feature: GYAE6OF01EQ59Z.48.71.G05.1.454.CMB.1.raw
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccgganaaattgtgttgacgcagtctccgaggccaccctgtctttgctcgagggaacncgcctacctctccgtgtacggccagtcagtaatgttaagcgccactccttagccgtaggtaccagaaccaaaaccgtcggaccgacgcccgtaccgacggtcctcctacacttctagtcggtcgaccgtccgaccggacggccacgtcgctacgtccgagtacgtacggttcgaggtcgacgtaggtcggtacgtacggacgacgtaccgttcaccgtactacccgactactaccgaacccgacgtaacgtacgggccttacggtacgtacgtttacggtttactttacggttacgtttacggtttttcgtttttaccggtcggttacgaacggtttagtaacggttaggttacggtaaccgtttaccgtaccggtacgtacgttaccgggtaccgggtaaccggtaaggggtaacccgtaaggggtaacgaaaccgttaaaccgaaacggttacggtacggtacgggtcctaacggtaccctaacggttaaccgttcggttaccgttacctttaccgtacccttaccccgtccggtaaacccg

SEQ ID NO: 106852 - DNA, 761 bp, Homo sapiens
  misc_feature: GYAE6OF01ATEXS.48.71.G05.1.454.CMB.1.raw
  modified_base (204)..(204): a, c, t, g, unknown or other
  misc_feature (204)..(204): n is a, c, g, or t
  modified_base (746)..(746): a, c, t, g, unknown or other
  misc_feature (746)..(746): n is a, c, g, or t
tcagagtatacatacacgaccggtgctcgatttagtgtcgtcgcaagagagagggggaagagctgctcagttaggacccagagggaaccatggaaaccccagcgcagctctcttcctcctgctactctggctcccagacaccaccggagaaacttgtgttgacgtcagtctcgaggcacccgtgtctttgtctccgagggaacncgccacctctcctgtacggcccagtcagtactgttaagacgcctacgtccttagccttaggtacccaagtaccaaaaaccgtcggaccctaacgcctacccgaggtcctccctagaaccgttctaacgtggttaccgccgttacccgaacccgaacggtaccaaccgttggaccctaacgtaccccgtaacgaacgtaacggttccgaaggtcgacgtaacggtcgggtctacgggaccgtaacgtaccgtttccgaaccgttccgtaaccgtacccgtaacgttacccgaaacccgttaaggacccgtttacgggaaccgttcccgttagacgtttacgttacgttttcgggaccgtttaagttttcggttttaacctgggtaccgttaacgtaccgtaagttacgttagtaacgtttccgtaaccgttaccggtaaacgtcgttaccgggtaccggaacgggttaacctaagggtaacgtaactacgtaaaccgtaacgtcggtaacggtcgtacgaccgtactcgtctcggttcctaancttaccgtcgtaccg

SEQ ID NO: 106853 - DNA, 761 bp, Homo sapiens
  misc_feature: GYAE6OF01BA95C.48.71.G05.1.454.CMB.1.raw
  modified_base (212)..(212): a, c, t, g, unknown or other
  misc_feature (212)..(212): n is a, c, g, or t
  modified_base (722)..(722): a, c, t, g, unknown or other
  misc_feature (722)..(722): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctgctcccgagaccaccaccggagtaaattgtgttgacgctagtcctcaggctaccctgttctttgtcctaccgaagggtaacnccgccctaccctctccgtggtacggacctagtacagtaatcgttaacgcgtacctacttccttagcccgttacggaacctaagaaccgtaaaaaccgtccggaaccgaccgtcccgtacccgtacggtcctcctacgtactcgtacgtcggtcgccgtacccaccgaccggtaccgaccgtcggtacctacctaccgacgtaccgtacggttacgacgtcggtacgtacggttcggtcgtacgggtacgtacgtacgttccaaccgtccgtaccgtaacctaaccgtacccaaccggtacgtaaccgtcgggaacgttaccgtacgtacgtttacgtttacggttttacgtttcgtttttaaccggtttttcgttaccgtcgttaacgttcgttacgttacggttacgttacgtacccgttacggacgtacgttcggtaccggacggttaaccgggaataacgggtacgaacgtaccggtaaacgttcgtacggacgtcgtatacccgtntacttagtccttactccgtactcccgtccgtcccgttag

SEQ ID NO: 106854 - DNA, 775 bp, Homo sapiens
  misc_feature: GYAE6OF01CJGG3.48.71.G05.1.454.CMB.1.raw
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaaccggagaaattgtgttagacgcagtctccgaggcaccctgtctttgctccgaggggaaacnccgaccaccctctccgtggtacgggccaagtcaagtaagtggttaagacgaccacttccttagcctggaccanacaaaactgccagcctccaggcctcctcgattctagtcggtacgccgtaccaccgtacggggccctacgtcgggacaccttaccccgaagtaaccgtaggttaccgagggtcggtacgtacgggttacggggttcgtacggggaacgtagtaaccctttccgacttaccctaccaacctacttacccgaccacggtacggtacggaccgtcgtaagtacgttaacggttacgttttacggactttacggtttcgtttttacgtacgttacgacgtacgttaacggttaagggttacgttaacgtttacccgaccgtttaccgggtaccgttaccgggttcccggaaccggggtaaccggggtaacccgtaacgggttaaacgaacgttaaaccggaaaccggtaagttccgggtacggaaccttgggacccttaacgtacgtttacccgtcggtttaacccttaccctacccgttttcccgtccccgttaaccg

SEQ ID NO: 106855 - DNA, 838 bp, Homo sapiens
  misc_feature: GYAE6OF01BYHBX.48.71.G05.1.454.CMB.1.raw
  modified_base (221)..(221): a, c, t, g, unknown or other
  misc_feature (221)..(221): n is a, c, g, or t
  modified_base (798)..(798): a, c, t, g, unknown or other
  misc_feature (798)..(798): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccgacggataaattgtgttcgacgcacgtcctaccgaggcctacccgttgttcctttcgtcctacggaaggggaaacncccgcccacccttctccgtggtacggcctaagtcgaagtaagttagttaaacgaccgacctaccgttacccttacgtacccgtacggtaaccaacgtaaaccctaaaaccgtcggaccacccgtccccgtacccgtacggtccttaccctacctagtttcgttaacggtcggtaccgtcccgtaaccccgaccggtaccgggaccccgtacggtaccgggccctaaccgttacccgaacggtaacgttacgggttacacggggttccggtacggttacgggtcgggtttacggaacgggtaacctacgtaaccctttcccgtaaccgttccctacccgaaacctaccgtaccgaaacccgtacgggaaccggttacggaaccttccggtattaacgtttggtttacgtttcggtactttaggtttttcggtttcctaacgtgtaacgttgtaaggtttacggttaccggtactttacccgtacggtaccgtaccgtacgggtaccgggacgaacgggtagtaaacggtaagtaaccctaagtaaccgtggttcggacgtcaacccggtctaacgttnttacccgtcgttaccaaccgtttcccgtcccttcctaacg

SEQ ID NO: 106856 - DNA, 703 bp, Homo sapiens
  misc_feature: GYAE6OF01EV0IV.48.71.G05.1.454.CMB.1.raw
  modified_base (130)..(130): a, c, t, g, unknown or other
  misc_feature (130)..(130): n is a, c, g, or t
  modified_base (193)..(193): a, c, t, g, unknown or other
  misc_feature (193)..(193): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactcnggctccagacaccacggagaattgtgtgacgcagtctcaggcacctgtcttgctcgagggaancgccacctctcctgtacggccagtacagaactgttaaagacgccactccgttagcctcggtaccagtacaaaaaccgtcgacacgccctaccgacggctcctcactacgtagtcggtcgccgtacccgaccgacgggaccacgtccggactacgtacccaaggtacgtaacggttacaggtacggtcgtaaggtcgggtacggtacgggaaccgtacgtaccttcgaaccttaccgtaccaaccgtataccaccgaacgtacgttcggacgtaccgtagtacgttacgttagtttacggacgttagttttcgttttacgtcggtctaacgcgtaacggttacgtacggtaacttcgaaccgttacggaacgtacgttaccgggtacggtaacgggtaaccgtaagggtaaacggaaagtaccgtaaaaccgtaacgttacgggtacggtaccgaacgtacccaccgtacgttcttacggttacctttacgacctttccgtacccggtacc

SEQ ID NO: 106857 - DNA, 514 bp, Homo sapiens
  misc_feature: GYAE6OF02G3MRP.48.71.G05.1.454.CMB.1.raw
  modified_base (389)..(389): a, c, t, g, unknown or other
  misc_feature (389)..(389): n is a, c, g, or t
  modified_base (496)..(496): a, c, t, g, unknown or other
  misc_feature (496)..(496): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctccaggctcctcatctatggtgcgtccaccagggccactggcatcccagacaggttcagtggcagtgggtctgggacagacttcactctcaccatcaccagactggacncctgatgatttgctagttgttttctgttcagtcagttatggaagttcaccgttcggactagttcggccaggggaccaaggtgaaactcaacgactggtgctgctacntctgtcttcatcctccgc

SEQ ID NO: 106858 - DNA, 542 bp, Homo sapiens
  misc_feature: GYAE6OF02HTJF3.48.71.G05.1.454.CMB.1.raw
  modified_base (419)..(419): a, c, t, g, unknown or other
  misc_feature (419)..(419): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggacgcctgatgtattttgctagttgtttttcngttcagctagtatggtaacgtttcaccttcggactagttccggccgaggggacccaagggtaggaaatcgaaacgtaacgtggtacggctgaccaccagtctgtccttacacttcctcccgcc

SEQ ID NO: 106859 - DNA, 517 bp, Homo sapiens
  misc_feature: GYAE6OF02GVRUB.48.71.G05.1.454.CMB.1.raw
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgtatttgctagttgttttctgtcagcagtatggagttcaccgtcggactagttcggccaggggaccaaggtgaaatacgaacgactgtggctgacacatctgtcttcacttccttcccgacc

SEQ ID NO: 106860 - DNA, 515 bp, Homo sapiens
  misc_feature: GYAE6OF02IAUN7.48.71.G05.1.454.CMB.1.raw
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacaggacttcactctcaccatcaccagactggacgcctgatgattttgctagttgttttctgtcagcagtatggagttcacctcggacagttcggccaggggaccaaggtaggaaatcaacgaactgtggctgcaccatctgtcttcactccttccgcc

SEQ ID NO: 106861 - DNA, 533 bp, Homo sapiens
  misc_feature: GYAE6OF02G372C.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggatcctcatctatggtgcgtccaccagggccactggcatcccagacaggttcagtgcagtgggtctgggacagacttcactctcaccatcaccagactggacgcctgactgtatttgctagttgttttctgttcagtcagttagtggaagttcaccgtcggactagttcggaccgagggaccaaggtagaactacgaacgtactggtggctgacacctagtctgtccttcacttccgtcccgtacc

SEQ ID NO: 106862 - DNA, 502 bp, Homo sapiens
  misc_feature: GYAE6OF02I6JAI.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggacgcctgatgattttgctagttgttttctgtcagcagtatggattcactcgacattcggcagggaccaaggtgaatcaacgactgtggctgcacatctgtccttcatcctccgc

SEQ ID NO: 106863 - DNA, 516 bp, Homo sapiens
  misc_feature: GYAE6OF02GSQX3.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgctagttgtttttctgttcagctagtatggaagttcacctcggactattccggcctaggggaccaagggtgaaatcaacgactggtggctgcacatctgtcttcattcctccgc

SEQ ID NO: 106864 - DNA, 538 bp, Homo sapiens
  misc_feature: GYAE6OF02GJ709.48.71.G05.1.454.CMB.1.raw
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggcctcctcatctatggtgcgtccaccagggccactggcatcccagacaggttcagtggcagtgggtctgggacaggacttcactcncaccatcaccagactggagcctgatgattttgcttagttttttcngttcagtcagttatgggtaactttcaccgttcggactagttcggccgaaggggtaccaaggtcggaaaatcgaaacgtactggtaggctagccaccatcgtgtcttcactcttcccgctac

SEQ ID NO: 106865 - DNA, 521 bp, Homo sapiens
  misc_feature: GYAE6OF02GPMH9.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccacctctcctgtagggccagtcagaatgttaagagccactccttagcctggtaccagcaaaaacctggccagcctcccaggctcctcatttatgatacatccaccagggccactggtgtcccagccaggttcactggcggtggtctgggacagagttcactctcacatcagcagcctgcagtctgaagtatttacattttattactgtcagcagtatcgtaagtgactccgacgtttggccaagggaccaaggtgaagtcaaacgactgtgctggcaccatcgtgtccttacagttccttcccgcctagtcttacg

SEQ ID NO: 106866 - DNA, 561 bp, Homo sapiens
  misc_feature: GYAE6OF02JBF5H.48.71.G05.1.454.CMB.1.raw
  modified_base (305)..(305): a, c, t, g, unknown or other
  misc_feature (305)..(305): n is a, c, g, or t
  modified_base (422)..(422): a, c, t, g, unknown or other
  misc_feature (422)..(422): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagacaaaaacctggccagcctcccaggctcctcatctatggtncgtccaccgagggccactggcactcccagacaggttcagtggcagtgggtctgggacagacttcactctcaccatcaccagactggacgcctgatgtattttgctagttgtttttcngttcagtctagtagtggtaagttcaccgtcggtactagttccggaccgacggggaccgaaagggtacggaaactaccgaaacgaactggtcggactcgacacctattccgtgttccttactacttcccttcccgtaccc

SEQ ID NO: 106867 - DNA, 516 bp, Homo sapiens
  misc_feature: GYAE6OF02H7JZQ.48.71.G05.1.454.CMB.1.raw
  modified_base (202)..(202): a, c, t, g, unknown or other
  misc_feature (202)..(202): n is a, c, g, or t
  modified_base (416)..(416): a, c, t, g, unknown or other
  misc_feature (416)..(416): n is a, c, g, or t
  modified_base (466)..(466): a, c, t, g, unknown or other
  misc_feature (466)..(466): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgctagttgtttttcngttcagcagttatggaattcacctggacagttcggccgagggaccaaggngtaaatcaacgactggtggctgcaccatctgtccttcattccctccaccc

SEQ ID NO: 106868 - DNA, 528 bp, Homo sapiens
  misc_feature: GYAE6OF02JJDDV.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagatgttaagagccactccttagcctggtaccagacaaaacctgccagcctccaggcctcctcatctatggtgccgtccaccgagggcccacgtggcactcccagacacggttcagtcggcaggtgggtctgggaccagacttcactctccacactcaccagactggacgcctgactgtatttgctagttgttttctgtctagctagtagtgaagttcaccgtcgactagtccgcgagggactaaggtagaatacgaacgacgtaggtgactgcctacatctgtcttcacttcctccgc

SEQ ID NO: 106869 - DNA, 548 bp, Homo sapiens
  misc_feature: GYAE6OF02IMQKN.48.71.G05.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggacncctgatgtattttgctagttgttttctgttcagctagtatggaattcacgtcggactagttccggaccgtaggggacccaaggtacgaaatacgaaacgaacgtggtacggctgaccaacctagttcctgttccttcgacttcccgttacccgtacc

SEQ ID NO: 106870 - DNA, 560 bp, Homo sapiens
  misc_feature: GYAE6OF02H79FJ.48.71.G05.1.454.CMB.1.raw
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccacctctcctgtaggccagtcagaatgttaagagccactcttagcctggtaccagcaaaaacctgccagcctccaggctcctcatctatggtgcgtccaccagggccactggcactcccagacaggttcagtcggcaggtgggtctgggacagacttcactctcaccatccaccagactggacgcctgatgtattttgctagtttgtttttcngttctagctagttagtggtaacgttcaccgtaggactacgttccggaccgaaggggacctaagggtagaaactaccgaaacgtacgtaggtggactagacctaacgattcgttacgtcctttacacttcccttcccgtacc

SEQ ID NO: 106871 - DNA, 521 bp, Homo sapiens
  misc_feature: GYAE6OF02FWOV2.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggacgcctgatgtatttgctagttgttttctgttcagtcagtatggaagttcaccgtcggactagttccggccaggggaccaagggtacgaaatcgaacgactggtggctgccacatctgtcttcacttcctccgc

SEQ ID NO: 106872 - DNA, 551 bp, Homo sapiens
  misc_feature: GYAE6OF02HMKFQ.48.71.G05.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctccaggctcctcatctatggtgcgtccaccagggccactggcatcccagacaggttcagtggcagtgggtctgggacagacttcactctcaccatcaccagactggancctgatgattttgctagttgttttctgttcagctagtatggaattcaccgtcggactagttcggaccgtaggggaacccaagggtacgaaatcgaaacgtaacgtggtagggcctaggccaacctagttccttggttcctttacacttcccttccccgtacc

SEQ ID NO: 106873 - DNA, 519 bp, Homo sapiens
  misc_feature: GYAE6OF02FR1K9.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgattttgctagttgttttctgttcagctagtatggtaagttcaccgtcggactattcggccgaggggacccaaggtgaaatcgaacgactggtggctgcaccatctgtcttcattccttccgcc

SEQ ID NO: 106874 - DNA, 745 bp, Homo sapiens
  misc_feature: GYAE6OF02HHGJS.48.71.G05.1.454.CMB.1.raw
tcagagtatacatacacgaccggtgctcgatttagtgtcgtcgcaagagagaggggggaagacgctcgcgtctagttagggaccctagagggtaaccatggaaaccccaggcgcaagcttctcttcctcctcgctactctggctcccagacaccaccggtagaaattggtgttgtaacgcagtctccaggcaccctgtctttgtctccgaggggtaaagccgggccacccttcgtcctggtacgggggccaggtcagtaatcgttaagagccactccttagcctggtaccagcaaaactggccagcctccaggctcctcatctatggtcgccgtccgaccgacgggccacgttgggcctacgtcccagtaccgtagggttaccgaggttcggactaggtacgggtacgtcggggacacggtaccttcgacgtccgtaccacctactaccaccgtacgtaccgtacggacgtacccgtgtaacgtagttactttcgacgttacgtttcggtttttactcggttaccgtacggtacttaacgggttaactacggggtaaccgtttcgaacccggttaccgggtaacctacggtttaccgggacccgtaacggggtaacccgtaaagggttacgtaaacgttacgaaaccggtaacgttcgggtacgggtccgttacgggtaccctaaccgtaggttccgttacggtttaccgttaccgtaacgtttcccggttaccccgtaacccgg

SEQ ID NO: 106875 - DNA, 518 bp, Homo sapiens
  misc_feature: GYAE6OF02GG3G8.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagccctggtaccagcaaaaacctggccagcctcccaggctcctcatctatggtgcgtccaccagggccactggcatcccagacaggttcagtggcagtgggtctgggacagacttcactctcaccatccaccagactggagcctgatgattttgctagttgttttctgttcagcagtatggaagttccacctcggactagttcggaccgaggggaccaaggtgaaatcaaacgactggtggctgcacatctgtcttcactctcccgc

SEQ ID NO: 106876 - DNA, 561 bp, Homo sapiens
  misc_feature: GYAE6OF02HBV3R.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccagacaccctgtctttgtctccaggggaaangccaccttctcctgcaggtccagtcagagtcttaccaacgactacttagcctggtaccatcagaaacctggccaggctccaggctcctcatctacggtgcatccagcagggccacgtggcatcccagacaggttcagtggcaggtggtctgggacagacttcactctcaccgtcagcagactcggacccgtgaagtatttgctagtacgtattacttgtcagctagttagtggtacgacgtcgaccgtactccgtaccgttccggaccgaacggacgacgtacgtacggaagtaacgttaaccgaacgtacggtacggtccgtacgaccgtaccgtacgttcgtcgttaccttctacg

SEQ ID NO: 106877 - DNA, 557 bp, Homo sapiens
  misc_feature: GYAE6OF02IH85L.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcactcccagacaggttcagtggcagtgggtctgggacagacttcactctcaccatccaccagactggacgcctgatgtattttgctagttgttttcttgttctagtcagttagtggtaacgttctaccgtacggtactacgttcggaccgacggggtaaccgtaaggtacggtaactacgaacgtacgtaggtcggctcgaccaccatcgtcgtccttctacttcctcccgtcc

SEQ ID NO: 106878 - DNA, 526 bp, Homo sapiens
  misc_feature: GYAE6OF02I3UQQ.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgctagttgtttttctgttcagtcagttatggtaattcaccgtcggactagttccggccgaggggaccaaggtagaaatcaacgactggtcggctgccaccatcgtgtcttcacttcctcccgtc

SEQ ID NO: 106879 - DNA, 543 bp, Homo sapiens
  misc_feature: GYAE6OF02HHVE4.48.71.G05.1.454.CMB.1.raw
  modified_base (203)..(203): a, c, t, g, unknown or other
  misc_feature (203)..(203): n is a, c, g, or t
  modified_base (416)..(416): a, c, t, g, unknown or other
  misc_feature (416)..(416): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctccaggctcctcatctatggtgcgtccaccagggccactggcatcccagacaggttcagtggcagtgggtctgggacagacttcactctcaccatcaccagactggagcctgatgtattttgctagttgttttcngttcagctagtatggtaagttcaccgttcggactagttcggaccgaggggaccaaagggtagaaatacgaaacgacgtggtcggctagacctaccagtcgtcgtccttacgacttccgtcccgtacc

SEQ ID NO: 106880 - DNA, 537 bp, Homo sapiens
  misc_feature: GYAE6OF02IR8DK.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccaacaaaaacctggccagcctcccaggctcctcatctatggtgcgtccaccagggccactggcatcccagacaggttcagtggcagtggtctggggacagacttcactctcaccatcaccagactggagcctgatgtattttgctagttgttttctgtcagtcagttatggtaagttcaccgttcggactagttccgggccagggggaccaaagggtcgaaatcgaaacgacgtggtcggcttagcctaccatctgtccttcatccttcccgctac

SEQ ID NO: 106881 - DNA, 578 bp, Homo sapiens
  misc_feature: GYAE6OF02GA2SU.48.71.G05.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctggccagcctcccaggctcctcatctatggtgcgtccaccacgggccactggcactcccagacaggttcagtgcagtgggtctgggacagactcactctcacatcaccagactggacncctgatgatttgctagttgttttctgttcagtctagtatggtaacgttcacgtcggactagttccggccgtaggggaccaagggtaggaaactacgaaacggtaacgttggtacgggtaccttaggaccctaacccgttaagttcccgttacggttaccctttacaactttccccgttacccccgtacc

SEQ ID NO: 106882 - DNA, 537 bp, Homo sapiens
  misc_feature: GYAE6OF02GT024.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgatttgctagttgttttctgttcagtcagtatggtaagttcaccgtcggactagttccggccgaggggacctaagggtacggaatacgaacgtacgtggtcggctacggctaccgattcgtgtccttcacttcctcccgtcc

SEQ ID NO: 106883 - DNA, 601 bp, Homo sapiens
  misc_feature: GYAE6OF02GUKQE.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcactcccagacaggttcagtggcagtgggtctgggacagtacttcactctcaccatccaccagactggacgcctgatgtattttgctagttgttttctgttcagtctagtatggtaagttccaccgttcggactacgtttccgggaccgtaacgggggtaacctaaagggtacggaaaacgttacgaaaaccggtaacgttagggtacggtaccgttacggcctaacccgtacgttaccgttacggttcctttaccgtaactttcccgttcccgtaccc

SEQ ID NO: 106884 - DNA, 628 bp, Homo sapiens
  misc_feature: GYAE6OF02HUXND.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaagcgccaccctctcctgtagggccagtcagaatgttaagagccactccttagcctggtaccagcaaaaacctggccagcctcccaggctcctcatctatggtgcgtccaccagggccactggcatcccagacaggttcagtgcagtgggtctgggacagacttcactctcaccatcaccgagacgtggactctgtatgttagtttcgacgtaggttttcgtttttctcggttacgtacgtacgttaagttagttagggttaacgttcccgtaccggttacggacgttacgttaccgggaccgggtaacgggtaacccggtaagggttaacgtaaacgttaaccgaaacggttacgttaggtacggtaccgttacgaccctaaccgtattacgttacgttccttacgtactttcccgttaccccgtacc

SEQ ID NO: 106885 - DNA, 550 bp, Homo sapiens
  misc_feature: GYAE6OF02HRZPH.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (393)..(393): a, c, t, g, unknown or other
  misc_feature (393)..(393): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngccactccttagcctggtaccagcaaaaacctggccagcctccaggctcctcatctatggtgcgtccaccgagggccactggcactcccagacaggttcagtggcagtgggtctgggacagacttcactctcaccatccaccagactggacncctgatgtattttgctagttgtttttctgttcagtctagtatggaagttcaccgttcggactacgttcggaccgagggtacccaagggtacgaaatcgaaacgtacgtggtggcttgacctaccgagtctcgtccttacgacttccttcccgtaccg

SEQ ID NO: 106886 - DNA, 540 bp, Homo sapiens
  misc_feature: GYAE6OF02F6FGV.48.71.G05.1.454.CMB.1.raw
  modified_base (409)..(409): a, c, t, g, unknown or other
  misc_feature (409)..(409): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtgcagtgggtctgggacagacttcactctcaccatcaccagactggacgcctgatgtatttgctagtntattactgtcagcagtatggtagcctactacctctaactcctactttccgggacggtaacggaccgtaagggtggaagtacgtaacgaaacgtacgtggtacggcgtacgctaccgtatcttcgtcttacg

SEQ ID NO: 106887 - DNA, 569 bp, Homo sapiens
  misc_feature: GYAE6OF02GKJED.48.71.G05.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccacctctcctgtagggccagtcagaatgttaagagccactccttagcctggtaccagacaaaacctggccagcctccaggctcctcatctatggtgcgtccaccgagggcccactggcactcccagacaggttcagtgcagtgggtctgggacagacttcactctcaccatcaccagactggacncctgatgtattttgctagttgttttctgttcagtctagttatggtaagttccacgtacggactagttccgggaccgaggggaacctaaagggtagaaactacgaaacgtacttacggtaggtactacggaccaaccgtagttacgttacggttcctttacactttccctacccgtacc

SEQ ID NO: 106888 - DNA, 568 bp, Homo sapiens
  misc_feature: GYAE6OF02JG4DH.48.71.G05.1.454.CMB.1.raw
  modified_base (202)..(202): a, c, t, g, unknown or other
  misc_feature (202)..(202): n is a, c, g, or t
  modified_base (389)..(389): a, c, t, g, unknown or other
  misc_feature (389)..(389): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccaccctctcctgtagggccagtcagaatgttaatagccactccttagcctggtaccagcaaaacctggccagcctcccaggctcctcatctatggtgcgtccaccagggccactggcatcccagacaggttcagtggcagtgggtctgggacagacttcactctcaccatcaccagactggacncctgatgtattttgctagttgtttttctgttcagtcagttataggaacgttcaccgtcggactagttccggccgaagggggaacctaaagggttaggaaacgttaccgaaacggtactgggtacggcctaggccaaccgtattccgttcgttccttactacttcccgttccccgtaccc

SEQ ID NO: 106889 - DNA, 615 bp, Homo sapiens
  misc_feature: GYAE6OF02IYIXJ.48.71.G05.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctggccagcctcccaggcctcctcatctatggtgccgtccaccgaggggccactggcactcccagacaggttcagtggcaggtgggtctgggacagtacttcactctcaccatcaccagactggacncctgatgtattttgctagtttcgttttctgttcagtctagttacgtggtaagttccaccgttcggtaacctagttccgggaccgtaacggggtaaccctaaagggtaacggtaaacgtaccgtaaaccggtaacgttacggtcgggtaccttacggacctaaccgtaagttcccgttacggtttacccttaccgtaactttccccgttaccccgtacc

SEQ ID NO: 106890 - DNA, 571 bp, Homo sapiens
  misc_feature: GYAE6OF02GMCFT.48.71.G05.1.454.CMB.1.raw
  modified_base (419)..(419): a, c, t, g, unknown or other
  misc_feature (419)..(419): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagtgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggacgcctgatgattttgctagttcgtttttcngttcagtcagttatggtaagttcaccgtcggactagttccggaccgtaggggacccaaagggtacgaaatccgaaacgactagggtacggaccttcggacctaaccgattaccgttacggttcctttacgactttcccgttccccggtaccc

SEQ ID NO: 106891 - DNA, 635 bp, Homo sapiens
  misc_feature: GYAE6OF02JTA24.48.71.G05.1.454.CMB.1.raw
  modified_base (141)..(141): a, c, t, g, unknown or other
  misc_feature (141)..(141): n is a, c, g, or t
  modified_base (267)..(267): a, c, t, g, unknown or other
  misc_feature (267)..(267): n is a, c, g, or t
  modified_base (308)..(308): a, c, t, g, unknown or other
  misc_feature (308)..(308): n is a, c, g, or t
  modified_base (468)..(468): a, c, t, g, unknown or other
  misc_feature (468)..(468): n is a, c, g, or t
  modified_base (602)..(602): a, c, t, g, unknown or other
  misc_feature (602)..(602): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacnccaccggagaaattggtgttgacgcagtctccaggtcaccctgtctttgctccgaggggtaaccgccacctctcctgtagggccagtcagaactgttaagagcctaactccttagcctggtaccanacaaaactggccagcctccaggctcctcactctaatcggtncgtaccaccagggaccacgtggcacttacccgagtacacggttcacggtcgccaggtcgggtctcggggaactaggtaccttcacctactccgaaccagttaccaacccgtagaaccgtgggaactccctagacttgtactttacgcgttaacggttttnttttcgagttcacggttacctaggttaatcgggtaaattcccgtaccgttacggtacttaacgttccgggaaccgttagggacccgttaaggtaagaacgtaacgtaagtactggtcggtactggaccaacgtnttaccgtcgtccttacgtacttacccgtcctac

SEQ ID NO: 106892 - DNA, 792 bp, Homo sapiens
  misc_feature: GYAE6OF02JFBWG.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggccaccctgtctttgtctccgaggggaaancgccaccctctcctgtagggccagtcagtaatgttaagagccactccttagcctggtaccagacaaaaacctggccacgccctcccgagcctcctcactctagtggtcgccgtccaaccgacgggccacgtcggacactcccgagaccgtaggttccaggtcggactaggttcggggtactggggactaggtaccttcgactccgtccaacctacgtaccaaccgtacggacgttacgggacgtaccgttacggtaacttacggttacgtttttcggacgtttacggttttacggttttttccgtggttaccgtaacggtaccgttaaggtttaagttacgggtaaaccggttttaccgaacccggtttccgggaaaccgtttaacccgggtttccggggaaacccgggttaaccggggggaaacccttaaacggggtaaaccgggtaaaacgttaacccggaaaaccggttaacccggttagggtttaacccgggacgttaacggtacccgttaacccgttaacgtttccggttacggttaccccgtttaaccctacccggtttacccttacccccgggtaaccc

SEQ ID NO: 106893 - DNA, 512 bp, Homo sapiens
  misc_feature: GYAE6OF02JBXOS.48.71.G05.1.454.CMB.1.raw
  modified_base (203)..(203): a, c, t, g, unknown or other
  misc_feature (203)..(203): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatcatggtgcgtccaccagggccactggcatcccagacaggttcagtggcagtgggtctgggacagacttcactctcaccatcaccagactggacgcctgatgtatttgctagttgttttcngtcngcagtatggagttcaccgtcgactgtcggccgtagggaccaaggtagaatcgaacgagtggtgctgacacatctgtctctactctcccgtac

SEQ ID NO: 106894 - DNA, 543 bp, Homo sapiens
  misc_feature: GYAE6OF02ISJZD.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaagcgccaccctctcctgtagggccagtcagaatgttaagagccactcctagcctggtaccagacaaaaacctggccacgcctcccaggcctcctcatctatggtgcgtccaccgagggccacgtggacacgtcccacgacaggttcaggtggcaggttggggtcgtgggacaggtacttcactctccaccatccaccagacgtggactcctgatgtattttgcttagtttgttttctgttctagtctagtatggtattcacgtcgtactagttcggacgagggaacaggtagaactacgaagactggtcgcgtgacacagtctgtccttcacttcctcccgac

SEQ ID NO: 106895 - DNA, 541 bp, Homo sapiens
  misc_feature: GYAE6OF02JI8T7.48.71.G05.1.454.CMB.1.raw
  modified_base (393)..(393): a, c, t, g, unknown or other
  misc_feature (393)..(393): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccgacgggccactggcatcccagacaggttcagtggcagtgggtctgggacagacttcactctcaccatcaccagactggacncctgatgtattttgactagttgttttctgtctagctagtatggtattcaccgtcggactagttccggaccgaggggaccaaagggtcgaaatacgaacgtacgtggtcggctgccacctagtcttgtccttacgacttcctcccgtac

SEQ ID NO: 106896 - DNA, 718 bp, Homo sapiens
  misc_feature: GYAE6OF02GN6O8.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcccgtacggtaccagaaccaaaaccgtcggaccacgccctacccgacggcctcctctactctagtcggtcgccgtacccaaccgacggcctacgtcggcacctcccgagacgtacggttacgaggtcggacgtaggttcgggtcgtagggactacgtaccttacgaccttctaccacctactacccaaccgtacgacgtaggaccgtccgtagagttagttagttttcggacgtttaggttttcgttttcgtacgttacgacgtcttaaggttagttacgggttaacgttcccgtaaccggttacggtaacttcggttacccgggaccgggtaaacggggtaaccgtaagggtaacgtaaacgtaccgaaacggttacgttgggtacggtaccgttcggaaccctaaccgttacgtttacgttccggtttacccttacctaccgtttcccccgttacccgtaccg

SEQ ID NO: 106897 - DNA, 524 bp, Homo sapiens
  misc_feature: GYAE6OF02I3JN3.48.71.G05.1.454.CMB.1.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
  modified_base (512)..(512): a, c, t, g, unknown or other
  misc_feature (512)..(512): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggacncctgatgtatttgctagttgttttcngttcagctagtatggtaattcaccttcggactacgttcggccgaggggtaccaggtagaaatcgaacgactggtggctgcacctagtctcgtcttnacttcctccgcc

SEQ ID NO: 106898 - DNA, 540 bp, Homo sapiens
  misc_feature: GYAE6OF02GDGTL.48.71.G05.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcactcccagacaggttcagtggcagtgggtctgggacagacttcactctcaccatcaccagactggancctgatgtattttgctagttntttttcgtgttcagctagttatggtaagttcaccgttcggactagtttcgggaccgtaggggtaccaaagggtcgaaatacgaaacgactggtcggctgcaccatctgtccttcacttccttcccgcc

SEQ ID NO: 106899 - DNA, 707 bp, Homo sapiens
  misc_feature: GYAE6OF02G9RQX.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggcctcccagaccaccgaccggagtaaattgtgttgacgcagtcctacgaggcctaccctgttctttcgtcctaccggaaggggaaacgccgaccctaccctctccgtaggtacgggcctagtcaagtaatagtaagacgcctacttccgttacgccgtaggtaccaagaacctaaaaccgtcggaccacgtcccctacccgacggtcctccctactacttctagtcggtcgccgtacccgaccggacgggccctacgtcggacctacctacccgagtacgtacggttcgtaggtcggacgtaggtcgggtcgtacggactagtaccttacacttcacctactatacccaacgacgtacgcggtacgtactagtagtagttatttcgacgttagtttcgttttcgcgttactagtacgttagttagtacggtacttccgaccggttacgtacttacggtccggaccgggtaacgggtaaccgtaaggtaacgtaaactaccgaaacgttcggtagggtacgaccgtacgaccgaccgttagtccgttacgtccttaccgtaccttccccgtaccacg

SEQ ID NO: 106900 - DNA, 568 bp, Homo sapiens
  misc_feature: GYAE6OF02FY4LJ.48.71.G05.1.454.CMB.1.raw
  modified_base (399)..(399): a, c, t, g, unknown or other
  misc_feature (399)..(399): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagccctggtaccagacaaaaacctggccagcctcccaggcctcctcatctatggtgcgtccaccgagggcccactggcactcccagacaggttcagtggcaggtgggtctgggacagtacttcactctcaccatcaccagactggacncctagatgtattttgctagtttcgttttctgttcagtctagtatggtaattccaccgtcgactagttccggacgacggggaccaagggtcgaaactacgaaacgtaacgtggtacggcttacggacctaccgtattccgttcgttccttactacttccgttcccgtacc

SEQ ID NO: 106901 - DNA, 592 bp, Homo sapiens
  misc_feature: GYAE6OF02I32O9.48.71.G05.1.454.CMB.1.raw
  modified_base (202)..(202): a, c, t, g, unknown or other
  misc_feature (202)..(202): n is a, c, g, or t
  modified_base (410)..(410): a, c, t, g, unknown or other
  misc_feature (410)..(410): n is a, c, g, or t
  modified_base (546)..(546): a, c, t, g, unknown or other
  misc_feature (546)..(546): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactcctggctcccagacaccaccggagaaattgtgttgacgcagtctccaggcaccctgtctttgctccaggggaancgccacctctcctgtagggccagtcagaatgttaagacgccactccttagcctggtaccagacaaaaacctggaccagaccctcccgaggtcctcctcatctatcggtgcgtccaccgacgggccactggcacgtcccagacaggtcaggtggcaggtcgggtctcgggacacggtacttcactctacaccactcaccagactggacncctgacgtgtagtttcgacttagtttcgtttctggtacagtctagtatacggtacgttacctacgtacgtactacgttcggtaccggaacggggtaaccgtaagggtagtaaacgtacgaaaccgtagttacgggngtacgtcgaccacgtctacgtcttctccgtacttccctcccgtacc

SEQ ID NO: 106902 - DNA, 581 bp, Homo sapiens
  misc_feature: GYAE6OF02IJKBH.48.71.G05.1.454.CMB.1.raw
  modified_base (203)..(203): a, c, t, g, unknown or other
  misc_feature (203)..(203): n is a, c, g, or t
  modified_base (437)..(437): a, c, t, g, unknown or other
  misc_feature (437)..(437): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccacctctcctgtagggccagtcagaatgttaagagccactccttagcctggtaccagacaaaaacctggccagccctccaggctcctcatctatggtgccgtccaccgacgggccacgtcggcactccccagactaggttccaggtcggcaggtgggtctgggacagacttcactctcaccatccaccagactggacgtcctagatgtattttgacttagtttcgttttcngttcgtagtctagttagtggtaacgttcaccgtggactacgttccggaccgacgggtaccgtaaaggtacgaaataccgaacgtacgttggtacggtcctcggacctaccagttcgtcgttccttctacttcccgtacccgtac

SEQ ID NO: 106903 - DNA, 640 bp, Homo sapiens
  misc_feature: GYAE6OF02HX3YL.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactcttagcctggtaccagcaaaaacctggaccagcctccaggctcctcatctatggtgcgtccacgagggccacctggcactcccagacgtaggtcagtcggcaggtgggtctgggacagacttcactctacaccatccaccgagactggacgcctagtatgtattttcgctagttcgttttttacgtgttcctagtacgtaagttagtaggtaacgtttccaccgttacggaactacgtttccgggaccgtaagggggtaaccctaaagggtaacgggaaaacttaccgaaaaccggtacgttacggtacgggtaccgttaggaccgtaaccctagttacccgtttacggttaccctttaacgttaccgtttccccgttaccccccgttacccg

SEQ ID NO: 106904 - DNA, 631 bp, Homo sapiens
  misc_feature: GYAE6OF02GMQI8.48.71.G05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgtaagngccactccttagcctggtaccagacaaaacctggccagcctccagctcctcatctatggtgcgtccaccaggccacgtggcatccagacaggttcagtggctagtcgggtctgggacaggtacttcgactctcacctatcaccagacgtggacgcctaggatgtagttttcgacttagtttgtttttctgttcgtagtactagttacgtaggtaacgttccgtaccgtacggtactacgtttccggaccgtaacgggggtaacccgtaaagggtacggtaaactccgtaaaacggtaccgttaggttacggtaccgttacggtaccctaaccgtacgttaccgttcggttaccctttaccgttacccgtttacccgttaccccgtaacccg

SEQ ID NO: 106905 - DNA, 580 bp, Homo sapiens
  misc_feature: GYAE6OF02G7XBA.48.71.G05.1.454.CMB.1.raw
  modified_base (297)..(297): a, c, t, g, unknown or other
  misc_feature (297)..(297): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccaacaaggcctggccagcctccaggctcctcatttangatacatccaccagggccacgtggtcgtcccagccaggttcacgtggcggtggtctgggacagacgttcacgtctcaccatcagcagcctgcagtctgaagtattttacattttatactgtacagtctagttactcgtaagtggaccttacgtacgtttacggccgtaagggaccgtaagggtacgtaaacgtacgaaaacgtactggtacggacttacggactaaccgtagttccgttagttaccttctacgtttcccttaccccggtctacgtccttacgg

SEQ ID NO: 106906 - DNA, 759 bp, Homo sapiens
  misc_feature: GYAE6OF02I4SLD.48.71.G05.1.454.CMB.1.raw
  modified_base (225)..(225): a, c, t, g, unknown or other
  misc_feature (225)..(225): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtcttgtctccagggaaagcgccaccctctcctgtagggccacngtacagtaatgttaacgagtcctaacgtcccttaggccctaggtacaaccgtacgaaacctaaacgtccgaaccacggtacctaccgacgtaccttacctactacgttactacgtcggtaccgtaccggtacccaaccggtaccggacctacggtccgactacctaccgtacgtacgtacggtaccgtaggtcggtacgtagggtacgtacggtacggtactacgtacctaccgtaacctacctaccgtaacctacgtacccgtaacgtaacgtaccgtacggtaaccgtacgtacgttacgttacgttacgtttacgttacgttacggttttacgttttacgttacgttacgtacgacgttaacggttaacggttaacggttaacgttaaccgtaaccggttaaccgtaaccgttaaccggttaccggtaaccgggtaaaccgggtaaaccggtaacggtaacgtaacgtaacgtaacgtaacgtacgtacggtacgtacgtaccgtaccgtacgtacgttacgttacgtacg

SEQ ID NO: 106907 - DNA, 540 bp, Homo sapiens
  misc_feature: GYAE6OF02H7AY0.48.71.G05.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
  modified_base (539)..(539): a, c, t, g, unknown or other
  misc_feature (539)..(539): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggcctcctcatctatggtgcgtccaccagggccactggcatcccagacaggttcagtggcagtgggtctgggacagtacttcactctcaccatcacagactggacgcctgatgtattttgctagttgtttttcngttcagtctagttatggtaacgttcaccgtcggactagttccggaccgaggggaccaagggtagaaactacgaaacgtacgtggtggctagacctaccatctgtcttcacttcctcccnc

SEQ ID NO: 106908 - DNA, 611 bp, Homo sapiens
  misc_feature: GYAE6OF02IPJAK.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatcatggtgcgtccaccagggccactggcactcccagaccaggttcagtggcagtgggtctgggacagtacttcactctcaccatccaccagactggacgcctagatgtattttgctagttcgtttttctcgttcagcgtagttagtaggtaacgttctaccgttacggaacctagtttccgggacccgtaagggggacccgtaaagggtacggtaaacgtaccgaaaccggtaacgttgggtaccggtaccgtgaacccgtaccctaacgttccgttacggttccctttaccgtactttcccgttaccccgtaccg

SEQ ID NO: 106909 - DNA, 534 bp, Homo sapiens
  misc_feature: GYAE6OF02HHFXD.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggacgcctgatgtattttgctagttgttttctgttcagtcagtatggagttcaccgtcgactacgttcggccgacggggaccaagggtagaagtaccgaacgacgtggtgctgccaccgtactcgtgtccttcacttccttcccgtcc

SEQ ID NO: 106910 - DNA, 553 bp, Homo sapiens
  misc_feature: GYAE6OF02FNQS6.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaaacctggccacgcctcccaggctcctcatctatggtgcgtccaccagggccacgtggcactcccagacaggttcagtggcaggtgggtcgtgggacagacttcactctcaccatccaccagactggacgcctgatgtattttgctagttcgttttctgttcagtctagtatggtaacgttccaccgtcgactagttccggccgagggacctaaggtagaaactacgaacgacgtggtcggcctgcctacctagttctcgttcttactacttccgttcccgtacc

SEQ ID NO: 106911 - DNA, 597 bp, Homo sapiens
  misc_feature: GYAE6OF02IP4GW.48.71.G05.1.454.CMB.1.raw
  modified_base (205)..(205): a, c, t, g, unknown or other
  misc_feature (205)..(205): n is a, c, g, or t
  modified_base (442)..(442): a, c, t, g, unknown or other
  misc_feature (442)..(442): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctgtagggccagtcagaatgttaagacgccactccttagcctggtaccagacaaaaacctcggaccacgccctcccaggcctcctcatctagtggtcgccgtccaccgacgggccacgtggccactcccagacgtaggttcagtggcaggtgggtcgtgggacagacttcactctcacatcaccgagactggacgcctgactgtatttgctagtttcgttttcngttcagtctagtagtaggtaacttcgaccgtcggactcgttcggaccgacggggaacctaaagggtacgaaacgttaccgaacgtaacgtggtcggtactcggacctaccgtacgttcgttcgttccttacgtacgttccccgttacccgtaccg

SEQ ID NO: 106912 - DNA, 588 bp, Homo sapiens
  misc_feature: GYAE6OF02IT29S.48.71.G05.1.454.CMB.1.raw
  modified_base (201)..(201): a, c, t, g, unknown or other
  misc_feature (201)..(201): n is a, c, g, or t
  modified_base (428)..(428): a, c, t, g, unknown or other
  misc_feature (428)..(428): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactccttagcctaggtaccagacaaaacctggccagcctccagctcctcatctatcgtgcgtaccacgacggccacgtcggcactcccgagacaggttcagtggcagtggtctgggacagtactcgactctcaccagtaccacagactaggacgtcctagactgtatttcgactaggttgttttcngtactagtctagttactggtaacttcgaaccgtcggactacgttcggaccgtagggtaaccaaaggtacggaaataccgaaacgcgttaggtacggtacctaggacctaaccgtagttaccgttcggtaaccttcgttaacttacccgttccccggtaac

SEQ ID NO: 106913 - DNA, 561 bp, Homo sapiens
  misc_feature: GYAE6OF02HZ9YR.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccatccttagcctggtaccagcaaaaacctggccagcctcccaggctcctcatctatggtgcgtccaccagggccactggcatcccagacaggttcagtggcagtggggtctgggacagacttcactctcaccatcaccagactggacgcctgatgtattttcgctagtttgtttttctgttcagactagtatggtaagttcaaccgttcggactagttccggaccgaggggtaaccaagggtagaaagtaccgaaacgacgtggtcggacctagaccacctagtaccttggttccttacacttcccgttcccgtaccc

SEQ ID NO: 106914 - DNA, 580 bp, Homo sapiens
  misc_feature: GYAE6OF02GDU7I.48.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaancgccacctctcctgtacgggccagtcagaatgttaagngccatccttagcctggtaccagacaaaacctgccagcctccaggctccncatctagtcgtgcgtaccaccgagggcccacgtggcactcccagactacggttcagtgacagtgggtctagggacagacttacnctctcacatccaccagacgtggacncctgatgtagtttgcgttagttcgttttcngttcagtctagtagtaggtacgttcaccgttacgtactacgttccggaccgtacgggacctaagggtacgtaactacgaacgtacgtcggtacggacttacgcctactacgttaccgttcgttaccttctaccgttcccttacccgtaccg

SEQ ID NO: 106915 - DNA, 527 bp, Homo sapiens
  misc_feature: GYAE6OF02FP4UG.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgctagttgtttttctgttcagtctagtatggtaagttcacctcggactagttcggccgaggggaccaaaggtggaaatcgaacgaactggtcggctgcacatctgtccttcacttcctcccgtcc

SEQ ID NO: 106916 - DNA, 571 bp, Homo sapiens
  misc_feature: GYAE6OF02HYE43.48.71.G05.1.454.CMB.1.raw
  modified_base (550)..(550): a, c, t, g, unknown or other
  misc_feature (550)..(550): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaagcgccaccctctcctgtagggccagtcagaatgttaagagccactccttagcctggtaccagcaaaaacctggccagcctcccaggcctcctcatctatggtgcgtccaccagggccactggcatcccagacaggttcaggtggcaggtgggtctggggacagtaccttcgaactcctacaccatccagcacgcctgcagtctagaagtattttacatttttattacttgttacagactagtatcggtaagttggaccttcggtaacgttttcggaccgtaagggaccctaagggtcgaaagtacgaaacgacgttggtcggactcggacaccgtatccgtgttccttnacttccgttaccccgactacg

SEQ ID NO: 106917 - DNA, 717 bp, Homo sapiens
  misc_feature: GYAE6OF02FENTQ.48.71.G05.1.454.CMB.1.raw
  modified_base (201)..(201): a, c, t, g, unknown or other
  misc_feature (201)..(201): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctcagcaccctgtctttgctaccgagggaacnccgccacctctccgtgtacggccagtcagatagtaagcgcctactctagcctaggtaccagaccaaaacctgcctacgcctccgacgcctcctacactcgtatcggtacgccgtaccgaccgtacggacctaacgtcggtacctaactacccgaaggtaaccgtaggtttaccgaggttcggacgtacgggttcggggtacgtacgggactacgtacctttacaccttctaccgaaccctagtacccaaccgacggacggtcgacgtacctttaggaactttgttacgtttcgacgttttacggtttcgtttttacccgtaggttactacggttagtaacggttacgttacggttaaccgttacccgtaccgtacgggtaccttacggttaccggggaaccgttaacggggaaacctaaagggtaacaaccgtaaccgtaagacgtcggtacgtacctacgtacctacttacgttcttaccggttacttaccctcccgttaccgtaccccgtaacg

SEQ ID NO: 106918 - DNA, 538 bp, Homo sapiens
  misc_feature: GYAE6OF02F2RI1.48.71.G05.1.454.CMB.1.raw
  modified_base (203)..(203): a, c, t, g, unknown or other
  misc_feature (203)..(203): n is a, c, g, or t
  modified_base (391)..(391): a, c, t, g, unknown or other
  misc_feature (391)..(391): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcactcccagacaggttcagtggcagtgggtctgggacagacttcactctcaccatcaccagactggancctgatgtattttgctagttgttttctgttcagtctagtatggtaagttccaccgttcggactagttcggccgaaggggaccaagggtagaaatcgaaacgactggtgctaggaccaccatcttgttccttacacttccttcccgac

SEQ ID NO: 106919 - DNA, 580 bp, Homo sapiens
  misc_feature: GYAE6OF02GP3Q8.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagacgccactccttagcctggtaccagacaaaaacctggccagcctccaggcctcctcactctatggtcgcgtccaccgaggggccactggccactcccagactaggttcagtggctagtgggtctgggacagacttcactctcaccatccaccgagtacgtggacgccgtgagtgtatttcgcgtagtttcgttttctgttcagtctagtacgttggtaacgttcaccgtcggtactacgttccggaccgtaggggacctaaagggtacgaacgtacgaacgtactggtcggtctacgacctaacgtcttcgtcgttccttacactttcccgtcccgtaccg

SEQ ID NO: 106920 - DNA, 566 bp, Homo sapiens
  misc_feature: GYAE6OF02GN955.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaacctggccagcctccaggctcctcattatgatacatccaccagggccactggtcgtcccagccaggttcacgtggcggtgggtctgggacagagttcactctacaccatcagcacgcctgcagtctagaagtattttactatttttatactgtacagtcagttatcgtaagtcggacctcgtacgtttggacctaacgggaccgtaaggtaggaaacgttcgaaacgacgttagtcggctaggaccaactactacgttcgttcttacctacgttcccttccccgactacgttctacgg

SEQ ID NO: 106921 - DNA, 643 bp, Homo sapiens
  misc_feature: GYAE6OF02IS2L6.48.71.G05.1.454.CMB.1.raw
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctgtaccagcaaaaacctggccagcctcccaggctcctcatctatggtgcgtccaccagggccactggcatcccagacaggttcagtggcngtggtctgggacagactcactctcacatcaccagactggacncctgactgattttgacctggtttgtttttcgttgttcgagtacgtagttacgttaggtaagtttccgaaccgttacggtaaccgtaggtttacccgggacccgtaacggggggtaaacccgtaaaggggttacgggaaaacgttaaccgtaaaaccggtaaacgttacgggtacgggtaaccttcggaacccgtaaccctaagttcccttagggtttaccctttaccgaacttttccccgttacccccgtacccg

SEQ ID NO: 106922 - DNA, 522 bp, Homo sapiens
  misc_feature: GYAE6OF02FF2Z5.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagccctggtaccagcaaaaacctggccagcctccaggctcctcatctatgtgcgtccaccaggccactggcatcccagacaggttcagtggcagtgggtctgggacaggacttcactctcaccatccaccagactggacgcctgatgtatttgctagttgttttctgtcagcagtatggaattcacctcggactacttcggccgaggggaccaagggtcgaaacgtacaacgactggtggctgaccacatctcgtcttcacttctcccgtc

SEQ ID NO: 106923 - DNA, 590 bp, Homo sapiens
  misc_feature: GYAE6OF02I64A3.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccacgcctcccaggctcctcatctatggtgcgtccaccagggccactggcatcccagacaggttcaggtgcaggtgggtctgggacagacttcactctcaccatcaccagactggacgcctgatgtattttgctagttgttttctgtcagtctagtatggtaattcaccgtacgactagttccggaccgtaacggggaccgtaaagggttacggaaagttaccgaaacgtacgtaggttacgggtacctaggaccctaaccgtagtttccgtcggtttaccttacccgtacctttcccgtttacccccggtaccc

SEQ ID NO: 106924 - DNA, 590 bp, Homo sapiens
  misc_feature: GYAE6OF02FQX1G.48.71.G05.1.454.CMB.1.raw
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccacctctcctgtagggccagtcagaatgttaagagccactccttagccctggtaccagaccaaaaacctcggccacgcctcccaggcctcctcatctatggtgcgtccaccaggccactggcactcccagacagttcagtgcagtgggtctgggacagcttcactctcaccatcaccagactggacncctagntgtatttgctagtttcgttttctgttcagtctagtattggtaacgttctaaccgtcggtactagttccgggaccgaggggaacccgtaaggtacggaaagttaccgaaaacgttaaccgtaggtaggtaccgttacgaccgtacctaagttccgtacggtttaccttacgtaacttcccgttccccggtacc

SEQ ID NO: 106925 - DNA, 609 bp, Homo sapiens
  misc_feature: GYAE6OF02JK7ZZ.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgcctccgaggggaancgccaccctctcctgtaggccagtcagaatgttaagagccactccttagcctggtaccagacaaaacctgccagcctccacggcctcctcatctagtggtcgccgtcccaccgacgggcccacgtcggccacgtcccagacgtacggttcaggtggcaggtcgggtcgtgggacagtactcactctacaccatccaccagtacgtggacgtcctagactgtatttcgacttaggtttcttttcgtagttcgtagtctagttagtaggtacgttccacgttacgtactacgttccggaccgtacgggtacctaaggtacgtaaactaccgaacggtaacgtcggtacggtactacggtacctacgtagttccgtacggttccttaacgtccttacccgtacccgtac

SEQ ID NO: 106926 - DNA, 824 bp, Homo sapiens
  misc_feature: GYAE6OF02IAVFI.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagaccaccaccggagtaaattgtgttgacgcagtctcaggcaccctgtctttgctccgaggggaanccgcctaccctctcccgtggtacggcctaggtcagtaattgtaagacgaccacttccgttacgctcggtaccagacaaaaccgtgaccagtcctaccgaggcctcctacactctacgtggtcgtccgtacccaccgtacgggcctacgtcggactaccgtcccgaaggaccgttacggttccgacggtcggtacgtaacggttcgggttcgacgggacgtaacgtaccttcgaaccgttccgtacctaccgtacgtaccaacccgtacgtaccgttacgggaccgtcccgtagtaacgttacggttacgttttacggaaccgtttaacggttttcgtttttaccgtaacggtttacgtaacgttacggttaaaccggttacgtttaacgggtaacccgtttaccggtaacccggtaaccggttaaaccgtccgggtttacccgggaacccgggttaaagggggtaaacccgtaaacggggttaacgtaaaacccgttaaccggaaaacccggtttaaccggtcggttaaccggtaccggtttaccggaccccgttaaaccggtcccttaccggttacttacccggttaacctaaccgtttcccccgtaccccgttaacccgg

SEQ ID NO: 106927 - DNA, 589 bp, Homo sapiens
  misc_feature: GYAE6OF02HYRSV.48.71.G05.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngccatccttagcctggtaccagacaaaaacctggccagcctccaggctcctcatctatggtgcgtccaccgagggcccactggcactccagacagtcagtgcagtgggtctgggacngacttcactctacacatcacagactggancctgatcgtatttgctagttntttttctgtcagctagtagtggtaacttccgaccgttacggaactacgttccgggacgtacggggaaccgtaaacgggtaggaaacttacgaaaacggtacgttcggtacggtccgttacggacctaaccgtacgtttcgttacggttaccttccctaacgtttcccgttaccccgtacc

SEQ ID NO: 106928 - DNA, 596 bp, Homo sapiens
  misc_feature: GYAE6OF02JHHQB.48.71.G05.1.454.CMB.1.raw
  modified_base (404)..(404): a, c, t, g, unknown or other
  misc_feature (404)..(404): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagacaaaacctggccagcctcccaggcctcctcatctatggtgcgtccaccgagggccacgtggcactcccagacaggttcagtggcaggtgggtctgggacagtacttcactcgtacacccatccaccgagaccgtggacncctgatgtattttgacgttagttcgttttctgttcagtctagtattggtaacgttcaccgttcggactacgttccgggaccgaacggggtaaccgaagggtacgtaaactaaccgaaacgtacgtcggtcggtaccgtaggaccctacgtacttccgtacgttccttactaccgttcccttaccccggtacc

SEQ ID NO: 106929 - DNA, 588 bp, Homo sapiens
  misc_feature: GYAE6OF02HXD7U.48.71.G05.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctaggtaccagacaaaaacctggaccagcctcccaggctccncatctatggtncgtccaccgaggccactggcatcccagacaggttcagtggcagtgggtctgggacagacttcactctcaccatccaccagactggacgtctagatgtattttgctagtttcgtttttcagttcagtcgtagtagtagggtaacgtttcaccgttcgggaactagttccggaccgtaaggggaaccctaaagggtacggtaaactaccgaaacgtacgtacggtcggtactcggaccaccgtagttcgtacgttccttactaaccttccgttaccccgtacc

SEQ ID NO: 106930 - DNA, 603 bp, Homo sapiens
  misc_feature: GYAE6OF02I9BOS.48.71.G05.1.454.CMB.1.raw
  modified_base (202)..(202): a, c, t, g, unknown or other
  misc_feature (202)..(202): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtacgggccagtcagaatgttaagagccactccttagcctggtaccagcaaaaacctggccagcctcccaggctccctcactctatggtgcgtccaccgaggccactggcactcccagacaggttcagtcggcaggtcgggtcgtgggacagtacttcactctcaccactccaaccagacgtgggaacnccgtagattggtattttcgcttaggttnttttcgtgttcagtctagtataggtagttcaccgtacggatacgttcggaccgtaaggggaaccaaagggttacgaaacgttaccgaaacggtacttacgggtcggtacctcggaaccgtaacccgtattccgttacggttccttacgtacttcccggttaccccgtacc

SEQ ID NO: 106931 - DNA, 722 bp, Homo sapiens
  misc_feature: GYAE6OF02ISM4P.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgattttagtgtcgtcgcaagagagagggggaagagctgctcagttaggacccagagggaaccatggaaaccccagcgcagcttctcttcctcctgctactctggctcccagacaccaccggagaaattgtgttgacgcagtcctccaggccaccctgttctttgtctccgaggggaanccgccaccctctcctgtacggccagtcagtaatgttaaagacgaccactccttagaccgttggtaccagacctaaaaaccgtcggaccacgtccctacccgacggtcctcccgtacactacctagttcggtcgccgttacccgaccgacggggccctaacgtcggacctacgtacccgaacgacgtaggttccgaggtcggacgtacggtcgggtcgtagggactacgacgttcacgtacgtacacctacgtacccaccgtagacgtacggacgtaccgtcgagtagttattttcgcgttagtttcgttttcgtgttcgtagacgttagttagtacgtacgttccgtaaccgtagtaaccgtagttaccggaccgtaacggggtaaccggtaaaggttacggaaacgttaaccggtaaacgttaacggttcggtaacggtaccgttacggtacccgtaacgttaccgttaccgttcgtttaccgttccgtaaccgttttcccgtaccccgtaaccg

SEQ ID NO: 106932 - DNA, 569 bp, Homo sapiens
  misc_feature: GYAE6OF02GZ413.48.71.G05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccacctcncctgtagggccagtcagaatgttaagagccactccttagcctggtaccagcaaaaacctggccagcctccaggctcctcatctatggtgcgtccaccaggggccactggcatcccagaccaggttcagtggcaggtgggtctgggacagacttcgactcncacatcaccagctggacgtccngatagactttgctagttcgttttcngtcagtcagtataggtaacgttcaccgtcggactacgttcggaccgacggggacctaaaggtacggaaacgtaccgaaacgtaacctgggtacggtacttacggcctaaccgtatccgttggttaccttcgactttcccgtcccgtaccc

SEQ ID NO: 106933 - DNA, 608 bp, Homo sapiens
  misc_feature: GYAE6OF02GHXF4.48.71.G05.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccacctctcctgtagggccagtcagaatgttaagngccactccttagcctggtaccagacaaaaacctggccacgcctccaggctcctcatctatggtgcgtccaccgacgggcccacgtcggcactcccagacgaggttcaggtggcaggtgggtctgggacagtacttcactctcaccataccaccagacctggaacgctagatgtatttcgctagtttcgttttctgttcagctagtagtggtaacttcgtaccgtacggtactacgtttccggaccggtaacgggaaccgtaagggtaaggtaaacgtaaccgtaaacggtacgttagggtacggtactaggaccctaaccgtagtaccgttacgttacctttacaccgtttcccttacccgtaccc

SEQ ID NO: 106934 - DNA, 607 bp, Homo sapiens
  misc_feature: GYAE6OF02JD720.48.71.G05.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaancgccaccctctcctgtagggccagtcagaatgttaagagccactccttagcctggtaccagacaaaaacctggccagccctcccaggcctcctcatctatggtcgccgtcccaccgacgggccacgtcggacactcccagactacggttcaggtggctaggtgggtctgggacagtacttcactctcaccatccaccagactggacncctgatgtatttgcttagtttgttttctgtacagtctagttagttacggtaacgttccgaaccgttcggtactacgttaccgggaccgtaacggggaaccgtaagggtacgtaaacgtaccgtaaacgtaacgttcggtacggtctacgacctaccgtagttcgttacgtaccttacgtacttcccgttcccgtacc

SEQ ID NO: 106935 - DNA, 662 bp, Homo sapiens
  misc_feature: GYAE6OF02G1ZB2.48.71.G05.1.454.CMB.1.raw
tcagagtatacatacacgaccggtgctcgatttagtgtcgtcgcaagagagaggggggaagagctgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaacgcctaggccaggcctcccagacctcctcatctatgtatgcgtctaccgagggccacgtggccgtcccggcctaggttcagtcgccgaggtcgggtcgtagggacaggtaccttcactcctcaaccatcacgccacgtacccgtagaccgtacccgtaaagttacttttacggtaccgggttttaacttaccggttcgtaccgtaacggtccgtaacgggtccgttaccgtaaccccgtaaacgttccgggacccttcgttacccgttaacccgggttccgggaccgggtacggaacccgtaagggtccggaacgtacgtaccgaaaacggtaccggttggtacggaccgttcggaccctaaccgtacgttaccttcggttaccctttcgtaaccg

SEQ ID NO: 106936 - DNA, 593 bp, Homo sapiens
  misc_feature: GYAE6OF02JTZ5S.48.71.G05.1.454.CMB.1.raw
  modified_base (204)..(204): a, c, t, g, unknown or other
  misc_feature (204)..(204): n is a, c, g, or t
  modified_base (550)..(550): a, c, t, g, unknown or other
  misc_feature (550)..(550): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccaccctctcctgtacgggccagtcagaatgttaagagccactcctagcctggtaccagacaaaacctgccagcctccaggctcctcatttatgtatacactccaccacggccacgtggtcgtcccagcccgaaggttccaacgtcggcgggttgggtctcggggactaggacgttcactctaccactatcagtccagcctgccagtctacgaagtactttactattttactacgttgtactagtactagttaatcgtaagtcgtacttaccgtacgttcggaccgtaacgggaccgtagggtacgaacgtacgaaacgtacgtggtacggcctagactacgtntccgtacgttctactacgttcctacccggacttacgtctacgg

SEQ ID NO: 106937 - DNA, 544 bp, Homo sapiens
  misc_feature: GYAE6OF02GSO77.48.71.G05.1.454.CMB.1.raw
  modified_base (325)..(325): a, c, t, g, unknown or other
  misc_feature (325)..(325): n is a, c, g, or t
  modified_base (460)..(460): a, c, t, g, unknown or other
  misc_feature (460)..(460): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactcctagcctggtaccagacaaaacctggccagcctccaggcctcctcatctatggtgctccaccacgggccactcggcnctcccagacaggttcagtggcaggtgggtctgggacagtactcgactctcaccatcaccagtctggactcctgacttgtactttgacgttgttacgttttctgtcagtctagtatggtaatctaccgcggtactnttcggacgagggaaccaaggacgaatacgaaacgtcgtaggtggcagtcacgtactctcggttcctacgtcttcctcccgtacc

SEQ ID NO: 106938 - DNA, 542 bp, Homo sapiens
  misc_feature: GYAE6OF02G0XLZ.48.71.G05.1.454.CMB.1.raw
  modified_base (334)..(334): a, c, t, g, unknown or other
  misc_feature (334)..(334): n is a, c, g, or t
  modified_base (425)..(425): a, c, t, g, unknown or other
  misc_feature (425)..(425): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacnggttcagtggcaggtgggtctgggacagacttcactctcaccatcaccacgactcggagcctgatgtatttgctagtttgttttctgttcngtctagtatggtagttcacctcggactcgttcggccgagggaccaggtaggaactacgaacgactggtcggacgtcgaccgtaccagttctcgttccttctaccgttctccctaccg

SEQ ID NO: 106939 - DNA, 722 bp, Homo sapiens
  misc_feature: GYAE6OF02H72QT.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggaagaaattgtgttgacgcagtctccaggccaccctgtctttgtctccgaggggaaancgccacctctcctgtacgggccagtcagaatgtaagagccactcttagcctggtaccagcaaaaacctggaccagcctccaggctcctcatctatggtcgccgtccaccgacgggccacgtcggcactcccgaagacgtacggttcaggtcggcgacggtcgggttcgtaggggaactacggtacctttcaaccttctacctacctactccaacgaacgtacgtcgggaacgtcccgttagacgttacgttacgttttcggaccgttaggttttgttttttactcggttactaggtacgtaaggttaagttacgggtaaacgttcctaaccggttaccggtactaacgtttaccgggaccggtaaacgggggtaacccgtaaaggggtaacggtaaaacgtaaccggtaaaaccggttacgttacgggtacggtaccgtacggaacccgttaaccgtacgttaccgttaccggtttacctttaccgtaccgttttacccccggttcccgtaacccg

SEQ ID NO: 106940 - DNA, 612 bp, Homo sapiens
  misc_feature: GYAE6OF02HXGJL.48.71.G05.1.454.CMB.1.raw
  modified_base (206)..(206): a, c, t, g, unknown or other
  misc_feature (206)..(206): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaacncgccaccctctcctgtagggccagtcagaatgttaagagccactccttagcctggtaccagacaaaaacctggaccagcctaccaggtcctcctcatctatggtcgcgtccaccgagggccactggcactccagacagttcagtcgcgagtgggtctgggacaggtactcacctctacaccactccacgagtacgtggactcgtgtaatgttattttgacgttagttttcgtttttcngttcacgntagttagtacggtaacgttcaccgtacgacctagttaccggacgtaacgggaaccgtaagggtaacgtaaacgtaaccaacggtaacgttgggtaggtacctacggaccttaaccgagttaccgttacggttacctttacgtacttcccgttacccgacc

SEQ ID NO: 106941 - DNA, 607 bp, Homo sapiens
  misc_feature: GYAE6OF02FO5T6.48.71.G05.1.454.CMB.1.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgctccagggaancgcacctctcctgtagggccaggtccagaatgttaagagccactccttagcctggtaccagcaaaactgcagcctccaggctcncatctatggtncgtccacaggcactgcactccagacagttcagtgcagtgggtctgggacaggacttcgactctacgaccactcacccagtacctggacgccgtgaactgtaacttttgacgtagtttcgttttacgtgttcaggtctagtacgtggtaagttccaccgttacgggtactaacggtttccggacccgtaagggggtaacccaaaggggttacgaaaacgtaccgaaacgtaacgtcggttaacggacgttacggtaccgaaccgttacgttaccgtacggttaccttaccgtacgttacccgttcccgtaaccc

SEQ ID NO: 106942 - DNA, 607 bp, Homo sapiens
  misc_feature: GYAE6OF02JGMIP.48.71.G05.1.454.CMB.1.raw
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggcctcctcatctatggtgcgtccaccagggccactggcatcccagaccaggttcagtggccaggtgggtctgggacagacttcactcnccacatccaccagactggacnccttgatgtattttgactagttgtttttctggttacagtctagtatggtagtctccaccttacttaaacgtttccgggcgggtaacgggtaacccgaaagggttgggaacgtcgttaaccgaaaacggtaacgttagggtcgggtacgttacggacccgtaaccgtaacttcgtttcggttaccctttccgtacctttcccgttacccccg

SEQ ID NO: 106943 - DNA, 814 bp, Homo sapiens
  misc_feature: GYAE6OF02JR5W8.48.71.G05.1.454.CMB.1.raw
tcagagtatacatacacgaccggtgctcgatttagtgtcgtcgcaagagagagggggaagagctgctcagttaggacccagagggaccatggaaaccccagcgcagcttctcttcctcctgctactctggctcccagacaccaccggagaaattgtgttgacgcagtctccaggcaccctgtctttgtctccgaggggaaagcgccaccctctcctgtagggccagtcagaactgtaagacgccactccttagcctggtaccagacaaaactcggccacgcctccacgctcctcactctacgtggtcgcgtaccaccgtacgggccctacgtcggacacgttccccaagacctacgggtttaccaacggttcggacctaacggttcgggggtaccgttcgggggaacctaacggttaccgttaccgtaaccttccgtaaccaccctaacgttcccaaaccgtacgggtactacgggtacgtacccgtttaggaacgttcgttaacgttttacggacctttacgggttttacgtttttccgttacgttaccgtaaacggtccttaaaggggtttaacgttacggggttaaaccgtttaccctaacccgggtttacggtaaccgtttaccgggttcccggggtaacccggtaaggggttaaaccccggtaaagggtaaacgggttaaaacccgtccgtaaaaacgggtccgtttaacggggtccggaaccgtttccgggaacccttacccgtaagttttacccgtacgggtttaccctttaaccgtaccgttttaccccggttaccccgtaacccg

SEQ ID NO: 106944 - DNA, 631 bp, Homo sapiens
  misc_feature: GYAE6OF02GX9P4.48.71.G05.1.454.CMB.1.raw
  modified_base (205)..(205): a, c, t, g, unknown or other
  misc_feature (205)..(205): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccaccctctcctggtagggccaggtcagaatgttaaagcgccacttccttagcctggtaccagacaaaacctggccacgcctccaggctcctcactctagtggtcgccgtccgaccgaggccactcggcactcccagactaggttcagtggctaggtcgggtcgtgggacagtacgttcactctacacctactacaccagaccgtggacgtccgtagattaggttattttgacgttaggttttcttttctggttctagtctaagttacgtaggtacttaccgtaccgtacgtaccgtattccgggaccggtaacggggaaccgtaagggttaacggaaacgtaccgaaacgttacgtagggtcgtacctacggaccttaactcgttacgttcgttaccgttacgtaccttcccgttaccctacc

SEQ ID NO: 106945 - DNA, 578 bp, Homo sapiens
  misc_feature: GYAE6OF02GXEWA.48.71.G05.1.454.CMB.1.raw
  modified_base (204)..(204): a, c, t, g, unknown or other
  misc_feature (204)..(204): n is a, c, g, or t
tcagagtatacatacacgaccggtgctcgatttagtgtcgtcgcaagagagaggggggaagagctgctcagttaggacccagagggaaccatggaaaaccccagcgcagcttctcttcctcctgctactctggctcccagacaccaccggagaaattgtgttgacgcagtctccaggcaccctgtctttgtctccaggggaaanccgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcgactctcaccatccaccagactggacgtcctgatgtagttttgctagttgtttttcgtgttacagtcgtagtagtggtaacgttcgaaccgttcggactacgttcggaccgtaggggaacctaggtacgaactacgaaacgtacgtacgtaggtctcgacctaccgtagttccgttcggttccttaccgacttcccgttacccgtacccg

SEQ ID NO: 106946 - DNA, 596 bp, Homo sapiens
  misc_feature: GYAE6OF02JJO0G.48.71.G05.1.454.CMB.1.raw
  modified_base (202)..(202): a, c, t, g, unknown or other
  misc_feature (202)..(202): n is a, c, g, or t
  modified_base (455)..(455): a, c, t, g, unknown or other
  misc_feature (455)..(455): n is a, c, g, or t
tcagagtatacatacacgaccggtgctcgatttagtgtcgtcgcaagagagaggggggaagagctgctcagttaggacccagagggaaccatggaaacccagcgcagcttctcttcctcctgctactctggctcccagacaccaccggagaaattgtgttgacgcagtctccaggcacactgtctttgtctccaggggaaanccgccaccctctcctgtacgggccagtcagaatgttaagagccactccttagcctggtaccagacaaaaacctggaccacgcctccacggcctcctcactctatggtacgccgtaccaccgacgggcccacgtcggcactcccagaccaggttcaggtcggctaggtcgggtctcgggacagtacttcactcgtcaccatccaccgagtacgtcggacgcctagattgtattttcgacttgttcgtttttcgngttcagtcgtagttagtggttaacgttctaccgtcggactacgttcgggccgtaacgggactaagggtcgtaaactacgaaacgacgtcggtagtactacgacctacgtagttctacgttcttactacgttcccttacccg

SEQ ID NO: 106947 - DNA, 592 bp, Homo sapiens
  misc_feature: GYAE6OF02INCS0.48.71.G05.1.454.CMB.1.raw
  modified_base (203)..(203): a, c, t, g, unknown or other
  misc_feature (203)..(203): n is a, c, g, or t
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccacttccttagcctggtaccagacaaaaacctggccagcctccaggctcctcatctatggtgcgtccaccgagggcccacgtggcactcccagactaggttcagtggcaggtgggtctggggacagacttcactctcaccatccacagactggacncctgatcgtattttcgcttagtttagtttttcngttctagctaagttataggtaacgttctaccgtagacgtagttccggaccgtaacggggtaaccgtaagggtaacgtaaataccgaaacgtaacgtggtacggactcggacctaaccgagttcgtacgttccgtttacacttccccgttacccgtacccg

SEQ ID NO: 106948 - DNA, 600 bp, Homo sapiens
  misc_feature: GYAE6OF02GPEH0.48.71.G05.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcaggtgggtctgggacagtacttcactctccaccatccaccagactggacncctgatgtattttgactagtttgtttttctgttcagtctagttatggtaacgttccaccgttcggactacgttccgggaccgtacgggggaacctaagggttaacggaaacgttaccgaaacgaacgttcggtacgggtaccgttcggaacctaccgtagttccgttacggttccctttactactttcccgttccccgtaaccg

SEQ ID NO: 106949 - DNA, 537 bp, Homo sapiens
  misc_feature: GYAE6OF02G0MB6.48.71.G05.1.454.CMB.1.raw
  modified_base (203)..(203): a, c, t, g, unknown or other
  misc_feature (203)..(203): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaactgccagcctccaggctcctcatctatggtgcgtccaccgtagggccacgtggcactcccagacaggttcagtgcaggtggtctgggacagtacttcacgtctaccgacctatccacacgacgtgacgctgatgtaatttgctagttcgttttcngtctancagttntagtatcacgtcgatatcgacgtagggacaggtagaactagaacctagtagtcggactacgccaacgtactcgttcgttcttacctacttccctccctac

SEQ ID NO: 106950 - DNA, 602 bp, Homo sapiens
  misc_feature: GYAE6OF02G4LY6.48.71.G05.1.454.CMB.1.raw
  modified_base (340)..(340): a, c, t, g, unknown or other
  misc_feature (340)..(340): n is a, c, g, or t
  modified_base (406)..(406): a, c, t, g, unknown or other
  misc_feature (406)..(406): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtacgggccagtcagaatgttaagagccactccttagcctggtaccagcaaaaacctggccagccctcccaggcctcctcatctatggtgcgtccaccgagggccacgtcggcatcccagacnggtacagtggctaggtgggtctgggacagtacttcactctaccaccatcaccacgacgtacggganccctgactcgttagtttcgtacttaggtttgtttttctagttcagtctagttacgtggtaacgttctaccgttccggacttagttccggacggacggggtaaccgaaacgggtagtaaacgtacgtaaacgtaattacggtggtaccgtgaacctaccgtacgttactcgttaccttctacttcccgttccctacg

SEQ ID NO: 106951 - DNA, 586 bp, Homo sapiens
  misc_feature: GYAE6OF02FRVBF.48.71.G05.1.454.CMB.1.raw
  modified_base (204)..(204): a, c, t, g, unknown or other
  misc_feature (204)..(204): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctgtagggccagtcagaatgttaagagccactccttagcctggtaccagacaaaaacctggccagcctcccaggctcctcatctatggtgccgtccaccgagggccacgtggcactcccagacaggttcagtggcagtgggtctgggacagtacttcactctacaccataccaccagactggacgcctgatgtatttgctagttgttttcgtgtcagtctagtagtggtaagttcaccgtcggtactacgttccggaccgtaacggggaaccctaaagggtacgaaaacgtaccggaaacgtacgtcggtacggaccttacggaccaccgtattccgtcgttaccttcgtactttcccgttcccgtacc

SEQ ID NO: 106952 - DNA, 748 bp, Homo sapiens
  misc_feature: GYAE6OF02HA2Q6.48.71.G05.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtccccagccaccctgtctgtgtctccgaggggaaangtccaccctctcctgcagggccagtgagagtctgacagctccttagcctaggtaccaanaaaggcctggccagcctcccgaggcctcctcatttangtatacatcccacgacgggccacgtggtcgtaccccagtccctagggttccaccgttggggccgggttagggtccgtgggggactacggtacgtttaccacgttcgtaccacctaattaccgaagccgtaacgtcccgttacggacgtaacggttccgttagggtaaacgtttaacgtttttaactaagtttttttaactaacgtttcgttaccgtaaggtacctaagttaacgttaccgtttaaaggtacgggtaccttaccgggttaccggttttagggaacccggtaaacggggtaaccgtaaaggggttacggtaaacgtaaccgtaaaaccgggtacgttagggttaccggacgtttacggacccgtaacccgtaagttacccggttagttttacccgtttacgtaacccgttttccccgtccccgtacccgttagttacccg

SEQ ID NO: 106953 - DNA, 559 bp, Homo sapiens
  misc_feature: GYAE6OF02GG2VF.48.71.G05.1.454.CMB.1.raw
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggcctcctcatctatggtgcgtccacagggccactcggcactcccagacaggttcagtggcaggtgggtctgggacagacttcactctcaccataccacaggactggagtcctagntgtatttgctagtttgttttcngttcagtctagtacgtggtacttcacgtcggatacgtcggaccgagggaccaaggtagaagtacgaacgtacgtggcgatcggtaccaccgtacttcgttaccgttcgttacctacgtttcccttccccgtaccg

SEQ ID NO: 106954 - DNA, 568 bp, Homo sapiens
  misc_feature: GYAE6OF02HPHQE.48.71.G05.1.454.CMB.1.raw
  modified_base (203)..(203): a, c, t, g, unknown or other
  misc_feature (203)..(203): n is a, c, g, or t
  modified_base (430)..(430): a, c, t, g, unknown or other
  misc_feature (430)..(430): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccgacggccactggcactcccagacacggttcagtgcgagtgggtctgggacagacttcactctacaccactccaccagacgtggactcctgacgtgtatttgcgttagtttgtttttcngttcgtagctagttagtaggtaacgttccacgttcgactagttccggacgtacggggacctaaggtagaagtaccaaacgacgttggtgccgttagacctacgtactcgttcgttccttacgtcttccctacccgtcc

SEQ ID NO: 106955 - DNA, 549 bp, Homo sapiens
  misc_feature: GYAE6OF02GF4IH.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaagcgccaccctctcctgtagggccagtcagatgttaagagccactccttagcctggtaccagacaaaaacctggccagcctccaggctcctcatctatggtgcgtccaccgagggccacgtggcactcccagacaggttcagtggacaggtgggtctgggacagtcttcactctcaccatccaccagacgtggacgcctagatgtatttcgctagttgttttctgttcagtcagtagtggtacttcgacctcggactagttcggccgagggaccaaggtagaatacgaacgtactggtgacgttgacctacgagttcttagttcttaccgtacttccttacccggtacc

SEQ ID NO: 106956 - DNA, 560 bp, Homo sapiens
  misc_feature: GYAE6OF02IN9FN.48.71.G05.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
  modified_base (393)..(393): a, c, t, g, unknown or other
  misc_feature (393)..(393): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagngcccactcctagcctggtaccagacaaaaacctggccagccctcccaggcctcctcatctatggtgcgtccacgacgggccactggcatcccagacaggttcagtgcngtggtctgggacagcttcactctcacatccaccagactggacnctgatgtatttgctagttgttttctgttcagtacagtagtggtaattcaccgttaggactagttccggacgacggggaaccagggtaacgaataacgaacgtaacgttcggtacggtctaggacctaccgtattccgttattccttacacttcccgtacccctaccg

SEQ ID NO: 106957 - DNA, 582 bp, Homo sapiens
  misc_feature: GYAE6OF02GARAG.48.71.G05.1.454.CMB.1.raw
  modified_base (203)..(203): a, c, t, g, unknown or other
  misc_feature (203)..(203): n is a, c, g, or t
  modified_base (436)..(436): a, c, t, g, unknown or other
  misc_feature (436)..(436): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaanccgccaccctctcctgtagggccagtcagaatgttaagagccactccttagcctggtaccagcaaaaacctggccaagcctcccaggctcctcatctacggtgccgtccaccagggccactcggcactccccagaccaggttcagtcggcagtcgggtctggggacaggactttcacttctacaccatccaccagactggacgcctgaactgtattttgctagttcgttttcngtcagtctaagtacgtggaactttccgaccgttacggactacgttccggaccggtacgggaaccaaggtggaaaactcgaaacggtactggtacggacttagaccacctactcgtacgttccttactactccttaccccgcttacg

SEQ ID NO: 106958 - DNA, 562 bp, Homo sapiens
  misc_feature: GYAE6OF02GHIHX.48.71.G05.1.454.CMB.1.raw
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccacgtggcatcccagacaggttcagtgcagtcgggtctgggacagacttcactctcaccatcaccagactggagcctgatgtattttgctagttgtttttcngttcagctagttatggtaattcgaccttcggactacgttccggccgtaaggggaacccaaggtaggaaactccgaaacgtacgtggtgggaccttgaccaacgtcttacgtcgttcgttacgtacttcccgttcccgtacccg

SEQ ID NO: 106959 - DNA, 844 bp, Homo sapiens
  misc_feature: GYAE6OF02J0M7E.48.71.G05.1.454.CMB.1.raw
tcagagtatacatacacgaccggtgctcgatttagtgtcgtcgcaagagagagggggaaggagctgctcagttaggacccagagggaaccatggaaaccccagcgcagcttctcttcctcctgctactctggctcccagacaccaccggagaaattgtgttgacgcagtctccaggcctaccctgttctttgtcctccgaggggaaagccgcccaccctctcctgagggtccagtcagacgtgtaacgcgcacctccttagccttacggtacccagacctaaaaacctcggccaacgccctcccgacggacctccctctacttccttagtacggtccgtcgtacccgaccgacggcctacgtcggcctaacgtccccgaagtaccgacggtttacgaacggtcggtcgtaccgggtgggttccgtacggggtaccaacggtacgttcctaaccgtccgttaccacccgtaactccgaacccgacgtaccggttcgggaacgtcccgttaggtaagttcggtttaacgttttacggtacgtttaacggttttcggttttttacgttaccgttcgttaccggaacgtttaaccggttagttacgggttaacgtttaacccggtacccggtacctaaccgggttacgtttacccgggaacccgggtttaaccggggaaaccgggtaaacgggtttaaccgggttaaaaacgggtaaccccttaaaacggggtaaccgtttcggtacgggggttaacccctcggtaaacccctttaaccgggtactttaacccggttccggttaaccctttttacccgacccgtttttacccggtcccccgttaccgg

SEQ ID NO: 106960 - DNA, 602 bp, Homo sapiens
  misc_feature: GYAE6OF02JHWPN.48.71.G05.1.454.CMB.1.raw
  modified_base (346)..(346): a, c, t, g, unknown or other
  misc_feature (346)..(346): n is a, c, g, or t
  modified_base (434)..(434): a, c, t, g, unknown or other
  misc_feature (434)..(434): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaagcgccaccctctcctgtagggccagtcagaatgtaagagccactccttagcctggtaccagacaaaaacctcggaccacgccctccccaggcctcctcactctatggtcgccgtccaccacgggccacgtggccactcccagacnggttcagtggcaggtgggtctgggacagtactcactctcacactacaccagactggacgtctgatgtattttgcttagttgtttttcngttacagtctagttagtacgtaagttccaccgttcggactacgttccgggaccgaaggggtacctaaagggtacgaaacgttacgaaacgtacgtaggtacggtactacggacctaacccgtagttaccgttcggttaccctttacacgtttccccttcccggtaacc

SEQ ID NO: 106961 - DNA, 564 bp, Homo sapiens
  misc_feature: GYAE6OF02F8V5W.48.71.G05.1.454.CMB.1.raw
  modified_base (205)..(205): a, c, t, g, unknown or other
  misc_feature (205)..(205): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctgtagggccagtcagaatggttaagacgccactccttagcctggtaccagcaaaaacctggccagcctcccaggctcctcactctatggtgcgtccaccgagggccacgtcggcacgtcccagacaggttcagtcgcagtgggtctggacagactcactcncacactcacagctggacnctgatcgtatttcgctagttgttttctgttacagtctagtataggtacttcacgtacgactgtccggacgtacgggaacctaggtagaaactacgaacggtacgtggtacggacttcgacctacgtacgtcgttacgttccttaactcttacccgttacccgtacc

SEQ ID NO: 106962 - DNA, 716 bp, Homo sapiens
  misc_feature: GYAE6OF02FR0BA.48.71.G05.1.454.CMB.1.raw
  modified_base (201)..(201): a, c, t, g, unknown or other
  misc_feature (201)..(201): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctcgagggaancgccacctctccgtgtacggccagtcagaatgtaagacgcctactccttagcccgtaggtaccagacaaaaacctcggccacgccctcccaggcctccctcatcctagtggtcgccgtcccaccgacggggcccacgtcggaccactccccgaagaccgtacgggttcacggttggccgtaggttcggggtcgtaggggaacctacggtacctttccgaaccgttcctacccgtaaccctacttacccgacccgtaagaccgtacgggtacgcccgttagtacgttcggttagttttcggaccgtttaggttttcgtttttcgttacgttacgacgtacgtaaggttacgttacgggtaacgtttcccgtaacccgttacggtacctacggtttcccggaccgggtaacgggtaaccgtaagggtaacgtaaacgtaccgaaacggtacgtagggtacggtcgtacgaccgaacgtcgttccgttacgttccttactaccttcccgtcccgtacc

SEQ ID NO: 106963 - DNA, 639 bp, Homo sapiens
  misc_feature: GYAE6OF02GBRXP.48.71.G05.1.454.CMB.1.raw
  modified_base (204)..(204): a, c, t, g, unknown or other
  misc_feature (204)..(204): n is a, c, g, or t
  modified_base (422)..(422): a, c, t, g, unknown or other
  misc_feature (422)..(422): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaancgccacctctccgtgtaggccagtcagaatgttaagacgccactccttagccttaggtaaccagacaaaaacctggaccagccctccgacggcctcctacactctagtcggtcgccgtacccaccgacgggcccacgtggaccactcccaagacgaggttcaggtacggcgaggtgggtcgtagggacagtactctactctcactactacacagtacnggacgctgatgtagtttgacgttaggtttcttttacgtcgttactacgtctagttatacggtaacttcgtaaccgtccgacgttacgttcggtaccggaagggtaaccctagggtaacgaaaacgtaccgaaacgtaagtcgggtacggtaccgtacgaccgtaacctacgttacgttacgtttaccttaccgacctttacccgtacccgttaaccg

SEQ ID NO: 106964 - DNA, 600 bp, Homo sapiens
  misc_feature: GYAE6OF02FMMHC.48.71.G05.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaanccgccaccctntcctgtaggccagtcagaatgtaagngccactccttagcctggtaccagcaaaaacctggccagcctccaggctcctcatctatggtgcgtccaccaggccactggcactcccagacaggttcagtggcaggtgggtctgggacagacttcactctcaccatccacagactggancctagatgattttgacttagttgttttcgngttcgtacgactaggttatagggtattccgtacgttcggtaactcgtttcggaccgtaacgggtaaccaaagggtttcgaaagtaccgtaaacgtacgttacgggtacggaccgttcgaacctaccgacgtttacgttacggttacctttaccggaacgtttcccgttaccccgtaacccg

SEQ ID NO: 106965 - DNA, 687 bp, Homo sapiens
  misc_feature: GYAE6OF02H11OD.48.71.G05.1.454.CMB.1.raw
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacacccaccggagaaattgtgttgacgcagtctccaggcaccctgtctttgtctccgaggggaagccgccaccctctcctgtacgggccagtcagaatgttaagacgccactcttagcctggtaccagacaaaaccgtgccacgcctccaggcctcctcatctagtggtcgtccgtaccaccgacgggcccacgtcggccactcccgaagacgtaggttcaggtcggcgtaggtcgggtcgtagggactacgtaccttctacctcctacaacctactaccaaccgacgaccgtggacctccgtagtacttgtattttcgacgtttagtttcgtttttcgtcgtcgtacgtagtaacggttagtacggtaaccgttccgtaacccggttacggtacgttacggttacccgggaccggtaacggggtaaccgtaaaggggttaacgtaaaacgttaccggtaaaccggttacgttagggtacggttacctacgggaaccctaccgacgtttccgtcgtttacccttacgtaccttcccgtacccgtacc

SEQ ID NO: 106966 - DNA, 659 bp, Homo sapiens
  misc_feature: GYAE6OF02H8C7Q.48.71.G05.1.454.CMB.1.raw
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagccgccaccctctcctggtacgggccagtcagaatgttaagagccactctagcctggtaccagacaaaacctggccacgccctcccaggcctcctcatctagtcggtcgccgtccgaccgacgggccacgtcggcactcccagacgtaggttcaggtggcgaggtcgggtcgtgggacagtaccttcactcctcacctactccaccagacgtggacgtcctgtatgttagttttgcgttagtttgtttttcgtgtcagtcgtagttagtacggtaacttccgaccgttacggtacgtacgttccgggaccggtaacgggggtaaccgaaagggttaacggtaaacgttaaccgaaaccggttacggtacggggttcggaccgttacggaacccgtaccgtacgttccgttacggttacccttacgttaacccgtttcccccgttacccggtaccc

SEQ ID NO: 106967 - DNA, 592 bp, Homo sapiens
  misc_feature: GYAE6OF02GU1L2.48.71.G05.1.454.CMB.1.raw
  modified_base (447)..(447): a, c, t, g, unknown or other
  misc_feature (447)..(447): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagcgccaccctctcctgtagggccagtcagaatgttaagagccactccttagcctggtaccagaccaaaaaccgtggccagccctcccaggctccctcatcctacggtcgccgtaccaccgacgggcccacgtcggcactcccagaccaggttcaggtggcagtcgggtcgtagggacagacttcactctacaccactcaccacgacgtggacaccgtgattcgtatttgactagtttgttttcngtcgagtcagtatggtactcgacgtcgacgtacgttaccgggcgacggggacctaagggtagtaacgtaccgaaacgtacgtaggtcggcgttagacctaaccgtacgtcgttcgtaccttacgtacttcccgttcccgactacg

SEQ ID NO: 106968 - DNA, 648 bp, Homo sapiens
  misc_feature: GYAE6OF02ICLLO.48.71.G05.1.454.CMB.1.raw
  modified_base (202)..(202): a, c, t, g, unknown or other
  misc_feature (202)..(202): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaanccgccaccctctctgtagggccagtcagaatgttaagagccactccttagcctggtaccagacaaaaacctggccagccctccacggctcctcatctagtcggtgccgtaccaccgagggcccacgtggccactcccagactacggttcagtcggcgaggtggggtctgggacagtacctttcactctcaacactccacagactggactcctgatgtatttgacttagttcgtttttcngttacngtacgtagttacgtaggtaacttccgaccgttacggaccttacggttaccggacccggtaacggggaacccgtaaagggtaacggtaaacttaaccggaaaaccgttacggttacgggtacggttaccgtcggtaacccgtaaccttaaccggttcgttaccgtttacccgttaccttaccgtttacccgtaccccgtacc

SEQ ID NO: 106969 - DNA, 628 bp, Homo sapiens
  misc_feature: GYAE6OF02FG4DZ.48.71.G05.1.454.CMB.1.raw
  modified_base (203)..(203): a, c, t, g, unknown or other
  misc_feature (203)..(203): n is a, c, g, or t
  modified_base (341)..(341): a, c, t, g, unknown or other
  misc_feature (341)..(341): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactccttagcctggtaccagacaaaaacctggccagcctcccaggcctcctcatctatggtgcgtccaccacgggccacgtcggcactcccaagacnggttcagtggcaggtggtctgggacagctcactctcacatcacagactggactcctagatgttatttcgcttagtttggttttcctaggttcagtcgtaaggttacgttagggtaacgttaccgaaccgttaccgggaccttaacggttccgggaaccgggtaacggggtaaccgtaaagggttcggaaaacgttaccggaaacgtaccgtaggttcgggaccttcgtacccgaaccttacgtccgttacgtaccttacgtaaccctttcccgttaccccgtacccg

SEQ ID NO: 106970 - DNA, 810 bp, Homo sapiens
  misc_feature: GYAE6OF02G2H5B.48.71.G05.1.454.CMB.1.raw
  modified_base (265)..(265): a, c, t, g, unknown or other
  misc_feature (265)..(265): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccgaggcaccctgtctttgtctccgagggaagccgccaccgtctcctgacggccagtccagaactgtaagagccactccttagcctggtaccngaacaaaaccgtggaccacgccctacccaggacctcctacacttacgtacgtacggtcgaccgtacccaaccggtaccggggaccctaacgtcgggacctacgtaccccgaagaccgtacggtccgaacggttggaccgtagggttcgggtcgttaccggggaacgtacgtaacgtttacgaccgtactaacccgtaacctactaaccctaaccgaacggtaccggtacgggtaccgacccgtaggtaacgtttacggtaagtttttcggacgtttacggtttttaaccggttttttccgttacggttacgtaccggttacgtaacgggttaacgtttacgggtaaacgtttcccgaaaccggtttaccggtaacgtttacggtttaccggggaccccggtaagggggaaacccgttaaacgggtaacggtaaaacggttaaccgaaccggggtaaccttagggtaccggtaccggttacgacccgtaaccgttacgttccggttactttaccttaccgtaccctttcccggtaccccctaacgg

SEQ ID NO: 106971 - DNA, 555 bp, Homo sapiens
  misc_feature: GYAE6OF02FY27J.48.71.G05.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaancgccacctctcctgtaggccagtcagatgttaaganccatccttagcctggtaccagcaaaactggcagcctccagctcctcatctatggtgcgtaccaccgagggcccactcggacactcccagacgaggtttcaggttcggcaggttcgggtctgggacagtacgttcactctcaccactccaaccgagactggacncctagattgtatttgcttagttgttttctgtcagtctagtntggtacttcactcgatagtccggacgtacgggactaggtagaactacgaacgtacgtggtcgactaggaccacgtacgtcgttcgttaccttacgacttcccgttaccgtaccc

SEQ ID NO: 106972 - DNA, 642 bp, Homo sapiens
  misc_feature: GYAE6OF02IDYGM.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaagcgccaccctctcctgtaggccagtcagaatgttaagagccactccttagcctggtaccagacaaaaacctggaccagcctcccaggcctcctcatctatggtcgccgtccaccgacgggccacgtcggaccactcccagaccgtaggttccaggttggcgtaggtcgggtcgtgggacacggtacttcactcctacacctatccaccgtacgtacgtggactccgtgtagttgtagtttttcgacttagttttcgtttttacgtcgttacgtagtcgtaagttacgtaggtaaccgttcgaaccgttacggaactacggttaccggaccggtaacggggtaaccgtaaagggtaggtaaactacgaaacggtacgtgggtcgtaccgttcgacctacctagttacgttacgttccttaccgtacttcccgttccctaccg

SEQ ID NO: 106973 - DNA, 534 bp, Homo sapiens
  misc_feature: GYAE6OF02JEQ1E.48.71.G05.1.454.CMB.1.raw
  modified_base (202)..(202): a, c, t, g, unknown or other
  misc_feature (202)..(202): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccatccttagcctggtaccagcaaaacctggccagcctccaggctcctcatctatggtgccgtccaccagggccactggcactcccagacaggttcagtggcagtgggtctgggacagacttcactctcaccatccaccagactggacgcctgatgtatttgctagttnttttcngttcngctagtntaggacttcaccgtcgactacttcggaccgtagggacctaaggtagaactcaaacgtagtcggtgcctagccaccgtatcgtctccgttacacttccctacccgtc

SEQ ID NO: 106974 - DNA, 766 bp, Homo sapiens
  misc_feature: GYAE6OF02JJIL2.48.71.G05.1.454.CMB.1.raw
  modified_base (294)..(294): a, c, t, g, unknown or other
  misc_feature (294)..(294): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctcaggggaagcgccacctctcctgtacgggccagtcagtaatgttaagagccacttccttagcctggtaccagaccaaaactggccacgcctccaggctcctnactctatggtcgctccgacgacgggccactggccactcccagactacggtcaggttgcgtaggtgggtaccgtgggaccgtacgtacttccgacttaccgtcaacccgtatacccgaacctacggtaccgtagggtacctacccgtagttaacgttaggtttacccgttttagtaccggttaaggtttttacgttttttcccgtaggttaaccgttacgacggttaagttaacggttacgggtaaaccgttttcccgacccggttaacgttacccgtaacgggttttacccggggacccgtaaacggggggtaacctaaagggggtttaaccgaaaaccggttacctaaacccggggtactttcgggtaccgggtacggtttaccgaacccgttaacggtttacctaccgggtttttaccggtaaccgttttaacccggtaacccgtttccccgttttaacccccgggaacc

SEQ ID NO: 106975 - DNA, 597 bp, Homo sapiens
  misc_feature: GYAE6OF02GE2SF.48.71.G05.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaaccggagaaattgtgttgacgcagtctccaggcaccctgtctttgtctccaggggaaancgccaccctntcctgtaggccagtcagaatgttaagagccactcttagcctggtaccagcaaaacctggccagcctccaggctcctcatctatggtgcgtccaccgagggccacgtggcactcccagacaggttccagtggcaggtgggtctgggacagactttcacttctcaccatccacgagactggacgcctgatgtattttgctagtttgttttctgttcagtctagtattggtaacgttcaaccgtacggacttacgttccggaccgtacggggtaacctaaagggtacggtaaactaccgaaaccgtaacgttacggtaggtaccttacggacctaccgtacgttcgttacgttacctttaccgtactttcccgttccccgtacccg

SEQ ID NO: 106976 - DNA, 588 bp, Homo sapiens
  misc_feature: GYAE6OF02I1OQD.48.71.G05.1.454.CMB.1.raw
  modified_base (204)..(204): a, c, t, g, unknown or other
  misc_feature (204)..(204): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttaagcctggtaccagacaaaactggccagcctcccaggctcctcactctatgtcgccgtccaccagggccacgtggcatcccagactaggttcagtcggcaggtgggtctcgggacagtacgttcactctcaccactcaccagacgtcggagtcctgactgtatttgacttagttcgttttctgtnagntagtatgaacgttcaccgtacggactacgttcggaccgacggggtaacctaagggtacgtaaacgtaccgtaaacgtacggttaggtacgggtctaacggacctacctagttcgttgttacccgttactcgtttaccctcccggtacc

SEQ ID NO: 106977 - DNA, 683 bp, Homo sapiens
  misc_feature: GYAE6OF02GA8HX.48.71.G05.1.454.CMB.1.raw
  modified_base (206)..(206): a, c, t, g, unknown or other
  misc_feature (206)..(206): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaaggggaaancgccaccctctacctggtaggccagtcagaatgttaagcgcctactccttagcctggtaccagaccaaaaactcggaccacgcctcccgaggtcctcctcactctagtcggtcgtccgtccaccgacgggcccacgtcggccactccccagaccgtaggttcaggtggcgtaggtgggtcgtgggacagtacttcgactctacaccnctacaccagacgtcggacncgtgtagttgttattttcgcgtttagtttcgtttttcgtgttacgagttacgagttacgttacgggtaacgtttccgtaaccgttacggtaccgttacggtttaccggggaccggtaaccggggggtaacctaaacgggtaacgtaaaacgtaccgtaaacggtacggtcgggttacgggaccttacggaacctaaccgtacgttccgttacgttacccgttacttaccgttcccggttaccccgtaaccg

SEQ ID NO: 106978 - DNA, 561 bp, Homo sapiens
  misc_feature: GYAE6OF02GGJH4.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaancgccacctctcctgtagggccagtcagaatgttaagagccactccttagcctggtaccagcaaaaacctggccagcctccaggctcctcatctatggtgcgtccaccgacgggccactggcactcccagacaggttcagtggcagtgggtctgggacagtacttcactctcacatcaccagactggacgcctgatgtattttcgctagttcgtttttctgttacagtctagttagtggtaagttcaccgttcggactacgttcgggccgtaaggggaccaagggtacgtaaagtaccgaaacgtacgtggtcggctacgcctaaccgcttcgttcgtccttctacttccgttcccgtcc

SEQ ID NO: 106979 - DNA, 693 bp, Homo sapiens
  misc_feature: GYAE6OF02ICBE4.48.71.G05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagagtatacatacacgaccggtgctcgatttagtgtcgtcgcaagagagagggggaagagctgctcagttaggacccagagggaaccatggaaaccccagcggcagcttctcttcctcctgctactctggctcccagacaccaccggagaaattgtgttgacgcagtctccaggcaccctgtctttgctccaggggaaancgccaccctntcctgtacggccagtcagaatgtaagagccactccttagcctggtaccagacaaaaacctggccagcctccaggctcctcatctatggtcgtccgtccaccgagggccactcggcactcccagacgtaggttcagtcgcgaggtgggtcgtagggactacgtacttcacttcctaccaccctactaccaaccgacgtacgtacgggactccgtagtacgttagttacgtttttgacgttaggttttcgttttttctcggtttcgaacgtcgtaacgttagttacgggttaacggttacctaaccggttaccgggtaccttacggtttaccccggggaccggtaacggggggtaaccgtaaaggggtaacggtaaaaccgtaaccgtaaaacccggtaacggttaggtaccgggtactacggaccctaaccgtacgttccgttacggttacctttcctaacgtttccccgtacccgtacccg

SEQ ID NO: 106980 - DNA, 622 bp, Homo sapiens
  misc_feature: GYAE6OF02IE63T.48.71.G05.1.454.CMB.1.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaanccgccaccctctcctgtacgggccagtcagaatgtaagagccactccttagctggaccagacaaaacctggccagcctccaggctcctacatctagtggtcgcgtaccaccgacgggccacgtggcacgtcccagactaggttcaggtggcaggttcgggtcgnggggaacacgacttcacttctccgaccactcccgaacacgactcgggacgtcccgtgtagtgttatttcgacttaggtttcgtttttctcgttcagtcgtaaggttgtaggtaacttcgaccgttcggactacgttccggacgtacgggtaccgtaaggtacgtaaacgtaccgaaacggtacgttacggtggtaccgtgacccgtaacgtcgttacgtcgtttaccgttacttaccgttccgtaccccgtaccg

SEQ ID NO: 106981 - DNA, 551 bp, Homo sapiens
  misc_feature: GYAE6OF02F53J6.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagcaaaaacctggccagcctcccaggctcctcatctatggtgcgtccaccagggccactggcatcccagacaggttcagtggcaggtgggtctgggacagacttcactctcaccatccaccagactggacgcctgatgtatttgctagttcgttttctgttcagctagtatggtaagttcacctacggactagttccggcgacggggacctaagggtagaaactacgaacgacgtggtacggctacggacctaccgtattcgtacgttccttcacttccctcccgtacc

SEQ ID NO: 106982 - DNA, 704 bp, Homo sapiens
  misc_feature: GYAE6OF02HSTCD.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaanccgccaccctctcctggtagggccagtcagaatgttaagcgccacttccttagcctggtaccagaccaaaaccgtggaccacgcctcccaggcctcctcatctagtggtcgccgtccaccgacgggcccacgtcggcactcccgagacgtaggttcaggtgacgtaggttcgggtcgtagggacacgtacgttctactctaccacctactccaccgagtacgtacggacgtccgtagtacttgttagttttcgacgttagttttcgttttttcgtagttcgtacgtacgttaaggttaacggttaggttaacggtttcccgtaaccggtttaccggtaacgttacggtttacccgggaaccggtaaccgggggtaaaccggttaaagggtaaacgtaaacgttaaccgaaaccggttacgtaggtacggtaccgtacgaccgtaacctacgttaccgtttacgttacctttacccgtaacgtttccccgttacccgtaccg

SEQ ID NO: 106983 - DNA, 858 bp, Homo sapiens
  misc_feature: GYAE6OF02FGDFA.48.71.G05.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccgganaaacttgtgttgacgcagtctccaggcaccctgtctttgctaccaggggaacnccgccacctctcctgtacgggccagtcagatgttaacgngccacttcctagcccttggtaccagaccaaaacctcggccacgcctcccaggtcctcctcactctatcggtacgccgtccaccgtacggccacgtggcactccaagtaccgtacggtttcgaacggtcggtaccgtacggttcggggtcgtacggggtaacctaacggtacccgtttaccgtaccgttccctaaccgtaaccctacgtacccgaacccgtacgtaacccggtaggtaaccgtacccgttaggaactttacgggtttaaccgtttttaccggaccgtttaaacggtttttccggttttttaacccgttaccggtttaccgaaccggttaacccgttaaagggttaacgttaaccggggtttaaacccgtttacccgtaacccggttaccgggttaaaccgttaaccgggtttacccggggtaaaccggtaaaccggggggttaaccctaaaagggggttaaccggtaaaccctaaaaccgggttaaccgtaaacccggttgggttaaccggtacggtacccgtaacccgttaacccgtaaccggtaccgttttaaccggttacccgtttaaccctacccggtttaccccgttaccccggttaaccc

SEQ ID NO: 106984 - DNA, 818 bp, Homo sapiens
  misc_feature: GYAE6OF02HOVPU.48.71.G05.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctcaggggaancgccacctntccngtaggccagtcagaactgttaagagccactccttagcctggtaccagacaaaactgccagcctccgaggctctcactctatggtcgcgtaccaccgagggaccacgtcggacacgtcccgaagaccgtacggtttaccgaggtcggtacgtacggtcgggtacgttacgggacgtacggtaccttaccgacttaccgtaccgtaaccctacgttacccgaaccgtacgtaaccgttacgggaccgtaccgtacggtaacttacggttacgttttcggacgtttacggtttacgtttttcgtacgtttacgtaacggtaccgttaaggttaacgttacgggttaaaccggttttaccgtaacccggtttaccggtaacgtaccgggtttacccgggtaacccgggtaaccgggggttaaccgtaaaacggggttaaccgggtaaaaccgttaaccggtaaaacccggtaaccggttttacggggtaaaccgggttcccggtttaaccggaaccccgttaacccggttaaccggtttacccggtttaaccgggtttaccctttaaccgttaacccggtttacccccgtttaccccggttaaccccgg

SEQ ID NO: 106985 - DNA, 680 bp, Homo sapiens
  misc_feature: GYAE6OF02HH5EG.48.71.G05.1.454.CMB.1.raw
  modified_base (532)..(532): a, c, t, g, unknown or other
  misc_feature (532)..(532): n is a, c, g, or t
  modified_base (608)..(608): a, c, t, g, unknown or other
  misc_feature (608)..(608): n is a, c, g, or t
tcagagtatacatacacgaccggtgctcgatttagtgtcgtcgcaagagagagggggaaggagctgctcagttaggacccagagggaaccatggaaaccccagcgcagcttctctcctcctgctactctggctcccagaccacccaccgaagaaattgtgttgacgcagtctccaggccacccgtgtctttgtctccgaggggaaagccgcccacccgtctccgtgtacgggccagtctaaggaattggttaagacgcccaacttctagccgtaggtaccaggtaaccaaaaaccgtcgaccgacgccttacccgacggcctcctcgactctacgtcgtgtccgtccaccgaggccaccgtcgacactccgataccgtaggtacgagtcggtacacggtgggttccgaggggacaaccggtacgttacacgtcctaccgacctacgtacccaacgtacgtacgacggacgttccccgaggtacttacgggtacttttacgacgtttagtttacgtttttcgagtccggtaancgtaaagtcgtaggactttccgaccgtacggtactagttccggcgaaacgggtaaccgaaggttaaccgaaacgtnaaaaccgtcgtaggtacgtccacggtaccaacgtcgttacctggttaccttagtaccttacgttccccgaac

SEQ ID NO: 106986 - DNA, 570 bp, Homo sapiens
  misc_feature: GYAE6OF02F2VHV.48.71.G05.1.454.CMB.1.raw
tcagagtatacatacacgaccggtgctcgatttagtgtcgtcgcaagagagagggggggaagagctgctcagttaggacccagagggaaccatggaaaccccagcgcagcttctcttcctcctgctactctggctccccagacaccaccggagaaattgtgttgacgcagtctccaggcaccctgtctttgtctccaggggaaagccgccaccctctcctgtaggccagtcagaatgttaagacgccactccttagccctggtacccagaccaaaaacctggccacgccctccccaggccttccctcactctatggtcgcgtccaccgaggccactcggcactcccagacacggttcagtggcgagtgggtctgggacagacttcacctctccaccactccaccagactggacgcctgatgtatttcgcttagttgttttctgttcagctagtataggtaacgttccaccgtcggtactacgttccggaccgaacggggacctaaaggtacgaaactacaaacgacgtggtcggactcgcactatcgtcgtccttctacttcctcccgtc

SEQ ID NO: 106987 - DNA, 633 bp, Homo sapiens
  misc_feature: GYAE6OF02H8XXA.48.71.G05.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctccngtaggccagtcagaatgttaagagccactccttagcctggtacagacaaaaacctggccagcctccagctcctcactctatggtncgtccaccgaggccactgacactccagactagttcaggtgcgtagtgggtctgggacagacttcactctacaccatccacgtagacgtggacgtcctagactgttacgttttcgcgtagtttcgttttttcgtcgttcgtacgtcgtagttagtaggtaacgtttaccgaccgttacgtacgtacgtttacgggacccgtaacggggtaccgtaaagggtaagtaaacgtaccgaaaccggttaacgttacgggttcggaccgttacggacctaacccgttagttaccgttcgtttaccgtttacgtaccgtttacccgttacccgtacccg

SEQ ID NO: 106988 - DNA, 721 bp, Homo sapiens
  misc_feature: GYAE6OF02JWAFL.48.71.G05.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgtctcgaggggaacncgccaccctctcctggtacggccagtcagaatgttaagngccactccttagcctaggtaccagaccaaaaacgtcgccaacgcctccaggcctacctcactctagtcggtcgccgtccaccgacgggccacgtcgactactacccgagacgtacggttccaggtcggctaggtcgggtcgtgggacagtacttcactctccgaactactccaaccgagaccgtaggacgtacctaggtaactacggttacttttacgacgttacggtttacgtttttccgtaggttaccgtacgtaccgtaaagttcggttaacggtaaccggtttacccgaacccggttaccgggtaacgttaccgttacccgggaccggtaaccgggggtaaaccgtaaacgggtaacgttaaacgtaaccgtaaaccggtaaacgttcgggttcgggtaacctacgggtaaccctaaccgttaacgtccgtttacgttaccgttacgtacccgtttacccgtccccgtaacccg

SEQ ID NO: 106989 - DNA, 690 bp, Homo sapiens
  misc_feature: GYAE6OF02H0OWT.48.71.G05.1.454.CMB.1.raw
  modified_base (201)..(201): a, c, t, g, unknown or other
  misc_feature (201)..(201): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaanccgccacctctcctgtaggccagtcagaatgttaagagccactcttagcctggtacagacaaaaccgtgccagcctccaggctcctcactctatggtcgcgttcccaccgtagggaccactcggcactcccagactacggttacagtcggctaggtcgggtcgtgggaaccagtacttcgacctcgtaccacctagtccaacgacgtacgtcggacgtccctagtagttacgttacgttttacgaccgtttagttttcggttttttcacggtttaccgtacggttcgtaagtttacggtacggtaacgtttcccgaacccggttcggtaacttacggtttcccgggaaccggttaaacggggtaccggtaaacgggtaacggtaaaccttacgaaaccggttaccgtacgggttacggtaccgttcgggaaccttaccgtaccttccggttacgttaccctttaccgactttacccttccccggtaacc

SEQ ID NO: 106990 - DNA, 579 bp, Homo sapiens
  misc_feature: GYAE6OF02I2YT6.48.71.G05.1.454.CMB.1.raw
  modified_base (202)..(202): a, c, t, g, unknown or other
  misc_feature (202)..(202): n is a, c, g, or t
  modified_base (562)..(562): a, c, t, g, unknown or other
  misc_feature (562)..(562): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtacgggccagtcagatgttaagagccactccttagcctggtaccagacaaaacctggccagcctccgaggctcctcactctagtggtcgccgtcctaccgacgggccacgtggcactcccacgacgacggttcaggtcgcaggtcgggtacgtcgggacagtacttcactctcaccactcacacgacgtggacgtctgactgtagtttcgctagtttcgttttcgcgtcgtgtactacgttataggtacttccgtacgtcggtactacgtaccgtccgacgggtactaaggtacgaataccgaacgtacgtacggtcgcgtcgactaccgatcgttcgtcttacncgttacctcccgtaccg

SEQ ID NO: 106991 - DNA, 634 bp, Homo sapiens
  misc_feature: GYAE6OF02HXC0N.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgagggaancgccacctctcctgtaggccagtcagaatgttaagagccactccttagcctggtaccagacaaaaacgtgaccacgcctacccacgcctcctactactactagtggtacgcgtaccgaccgacggccactcgcactcccagacgacggttacaggtcggctaggtggtcgtagggactacgtactcactccgtacacctactaccacaacgtacgtagggacgtaccgtagtacgtagtagttttacgacgttacgtttcggtttttactgttacgtagtacgtagttagtacggtaacgttacgtacctacggtaccgtagttaccgggtacgtaacgggaaccgtaaagggacggtaacgtacgtaaacgtacgtaggtcggtactcggacctacctatcgttacgtccgttacacttcctacccgtacc

SEQ ID NO: 106992 - DNA, 644 bp, Homo sapiens
  misc_feature: GYAE6OF02H9J7O.48.71.G05.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctccnggtagggccagtcagaatgttaagagccactcttagcctggtaccagacaaaacctggccagcctccagctcctcatctatggtnccgtccaccgagggccacgtcggcactccagactacggttcagtggcaggtgggtcgcgggacagacttcactctacacctactccaaccacgacgtggacgtcccgtagtatagtattttcgacttagtttgtttttcgtcgttacctagacgtagttagtgggtaaccttcgtaccgtacggtactacggttccggaccgtaaggggaacctaaagggtacgtaaaacgtaccgaaaacggtacggttacggtcgggtacctacggtaccctaacccgttacggtttaccgttaccgtttaccgtttaaccgtaaccgtttccccgttaccccgttaaccg

SEQ ID NO: 106993 - DNA, 713 bp, Homo sapiens
  misc_feature: GYAE6OF02IVVM7.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccgaggcaccctgttctttgtctccgagggaagccgccaccctctcctgtacggccagtcagtaactgttaagacgcctactccttagccgtagtaccagaacctaaaaccgtcggaccacgtccctcccgacggcctcccgtacacgttactagttcggtcgtaccctacccgaccgaccgggcctaccgtcgacctacgtacccaaggaccgtacggttaccaggtacggtacgtacggttgggtcgtaagggactacgtacgttccgacgttactaccgacctctaccgacctagaccgtcggactccgtagtagttacgttacgtttcgacgtttacgttttcgttttacgtacggttactcggttaactaaggttacgttacgggtaacttacccgtaccggtaccgttaagtaccgttcccgggacggttaaccgggaacgtaaggtaacggtaacgtaaccggtaaccgtaaggtcgtaacgtaccggtgaacccgtacttagttccgattcccgtctactcccggtcctaaccg

SEQ ID NO: 106994 - DNA, 597 bp, Homo sapiens
  misc_feature: GYAE6OF02FWFSS.48.71.G05.1.454.CMB.1.raw
  modified_base (204)..(204): a, c, t, g, unknown or other
  misc_feature (204)..(204): n is a, c, g, or t
  modified_base (439)..(439): a, c, t, g, unknown or other
  misc_feature (439)..(439): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaanccgccaccctctcctgtacgggccagtcagaatgttaaagagccactccttagcctggtaccagacaaaaacctggaccagcctaccaggctcctcatctatggtgcgtccaccgacgggccacgtggcactcccagacaggttcagtggcaggtgggtcgtagggacagtacttcactctaccacatcaccagacgtggacgcctgactgtatttcgacttagttcgtttttcngttacgagtactagttagtaggtaacgttacaccgttacggactacgttccggaccgaaggggtaaccaaagggtacgaaacgtacgaacgtaacgtggtacggtacgtacgacctacctacgttactgttaccgttactaccttccttcccgtaccg

SEQ ID NO: 106995 - DNA, 621 bp, Homo sapiens
  misc_feature: GYAE6OF02F5AQ3.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtacggccagtcagatgttaagagccactcctagcctggtaccagacaaaacctggccacgcctcccaggctcctcatctatggtgccgtccaccgacgggcccacgtcggacactcccagacgtaggttcaggtcggctaggtgggtctgggacagtacttcactctacaccataccaccgagacgtaggacgtccgtagattgttagttttcgacgttacgtttcgtttttcgtggttactagtacgtagttacgttggtaacgttcgaccgttacggacgttacgttccgggaccgtaacggggtaccgtaaagggtacgaaacgtaccgaaacgtacgttaggtcggactacgaccaccgtagttcgtcgttaccttacgacgtttcccgtacccgtaccg

SEQ ID NO: 106996 - DNA, 607 bp, Homo sapiens
  misc_feature: GYAE6OF02GGVUS.48.71.G05.1.454.CMB.1.raw
  modified_base (203)..(203): a, c, t, g, unknown or other
  misc_feature (203)..(203): n is a, c, g, or t
  modified_base (451)..(451): a, c, t, g, unknown or other
  misc_feature (451)..(451): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccacctctcctgtagggccagtcagaatgttaagagccactccttagcctggtaccagcaaaaacctggccagcctacccaggcctccctcactctatggtgccgtccaccacgggcccactcggccactccccgagacaggttcaggttggcctaggtcggggtctggggacaggaccttcgactctccgacacgttaccaccagacgtggaactcctagatgttatttgcttagttgtttttcngttcagtctagtacgtaggtagttccacgttcggaacctagttccggaccggtaaggggtaacccaagggtacgaaacttacgaaacggtacgtgggtcgtactcgtaccgtacgtacttcgtcgttaccttccgtacgtttcccgtaccgtaccg

SEQ ID NO: 106997 - DNA, 707 bp, Homo sapiens
  misc_feature: GYAE6OF02GKVXW.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgctccgaggggaanccgccacctctcctggtacggccagtcagaatgttaagcgccactccttagccttggtaccagaccaaaaccgtcggaccacgtccctacccgacggtcctccgtacacttactacgtaggtcgtaccgtaccgaccgacgggccaaccggtcggccaacgtcccgagtaccgtacgggttaccgaggtcggacgtacggtcggggtacggtagggaccgaggtacccttacgacgttacccgtccaccgtactacccgaccgaacgtacggtcggaacctccgtagtacttagttacgtttaggcttaggtttcgttttacgtggttcgacgtataggttagttcggtaacttacgtaccgtacgtacctacggttcccggacggaacggggtaaccgtaggggttaacgaaacgtacccgtaaacggtacgtacggtcggacggtaccgtacgaacccgtgtaccgttacggttacgtacgttaccttacccgttcctaccg

SEQ ID NO: 106998 - DNA, 705 bp, Homo sapiens
  misc_feature: GYAE6OF02GRPKE.48.71.G05.1.454.CMB.1.raw
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaacttgtgttgacgcagtctccgaggcaccctgtctttgctccgaggggaaacgccgccacccgtctaccgtgtacgggccagtcagaattgtaagacgccacgtccttagcctggtaccagacaaaacgtgcagcctccaggctcctgactactatcggtcgctccgaccgacggccactcggcaccgtacccgagaccgtacggttccaaggtcgacgtacggtcgggtactagggaccacggttaccgttactaccgtctaccgaccctacgtaccaccgaacgtaccgtggaaccgtccgtaggtacgttcgttaacgttttccgacggtttagttttccggttttcgtagttaccgtaacggtacttaacggttagtacggttaaacgttcccgtaaccgttacggtacgtacgttaccggaaccggtaacgggtaacccgtaaagggtacgtaaacgtaaccgtaaccgtacggttacggtacgacgttaccgaacccgtaactacgttcgtaccgttccttaaccttaccgttcccgtaccctaccg

SEQ ID NO: 106999 - DNA, 668 bp, Homo sapiens
  misc_feature: GYAE6OF02IBXVS.48.71.G05.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
tcagagtatacatacacgaccggtgctcgatttagtgtcgtcgcaagagagagggggaagagctgctcagttaggacccaggagggaaccatggaaaccccagcgcagcttctcttcctcctgctactctggctcccagacaccaccggagaaattgtgttgacgcagtctccaggccaccctgtctttgtctaccgaggggaanccgccaccctntccgngtacgggccagtcagatgtaaganccactctagcctggtacagacaaaacctgccagcctccaggcctcctcatctatggtcgccgtccaaccgacgggccacgtcggaccactcccagaccgtacggttcaggtcggacgtaggttcgggtcgtacggggacacgtacttacaccgtctaccacctacgtccaaccgtacgtacgtggaccgccttacggtactggttattttcggacgttaggttttcgtttttacgtacggttacgtacgtcgttagttacgtacggttacttaccgtaccgtacggtacgtacggttacccgggaaccggtacggggaaccgtaaagggtacggtaaactaccgaaacgtacgtggtccggtacgtacgaccccgtaactccgttcgtacggttccttacctaccgttccccgtacccgtacc

SEQ ID NO: 107000 - DNA, 672 bp, Homo sapiens
  misc_feature: GYAE6OF02HMJ28.48.71.G05.1.454.CMB.1.raw
  modified_base (205)..(205): a, c, t, g, unknown or other
  misc_feature (205)..(205): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaaancgccaccctctcctgtacgggccagtcagaatgttaaagacgccactccttagcctggtaccagacaaaaccgtgaccacgcctccacgcctcctcatctagtcggtcgaccgtccaccgacgggaccacgtcggctacgtccaaggtaccgtaggttacaggtcggacgtaggtgggtcgtacgggactaggtaccttctaccgttccgtaccaccctacgtaccctaaccgtaacgacggttcggaccgtaccgtagtacgtaggtttatttacgtacgtttacgtttcgtttttctcgttacgtagttacgttagttagtacgggtaacgttccgtaaccggttacgtaccgtacggttccggaccggtaacgggtaaccgtaaggtaacgaaacgttacgaacgtacgtagtacggtcgtaccgactaccgtattcgtacttctaccgtacttccgccctacg

SEQ ID NO: 107001 - DNA, 588 bp, Homo sapiens
  misc_feature: GYAE6OF02GKXO8.48.71.G05.1.454.CMB.1.raw
  modified_base (270)..(270): a, c, t, g, unknown or other
  misc_feature (270)..(270): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
tcagagtatacatacacgaccggtgctcgatttagtgtcgtcgcaagagagaggggggaagagctgctcagttaggacccagagggaaccatggaaaccccgacgcgcagcttctcttcctcctgctactctggctcccagacaccaccggagaattgtgttgacgcagtctccaggcaccctgtctttcgtctccaggggaaagccgcccaccctctcctgtagggccagtcagaatgttaagacgccacttccttagcctggtaccanacaaaacctggccacgccctccacggcctccctcactctgtggtgccggtccaccgacgggccacgtcggcactcccgaagacaggttcgagtggcnggtgggtcgtgggacagtccttcactcncacatcaccngctgcgctgntgtntttgntagtttcgttttcncgtncgtctagtatggtacttctacctcggcttacgtccggacgtaacgggacgtacgggtaagaacttacggaacgtcgttacggtggacctacggacctaccgtagttccttacggttaccttaccgtacgttcccgttacccgaccg

SEQ ID NO: 107002 - DNA, 648 bp, Homo sapiens
  misc_feature: GYAE6OF02FWY7T.48.71.G05.1.454.CMB.1.raw
  modified_base (394)..(394): a, c, t, g, unknown or other
  misc_feature (394)..(394): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccacctctcctgtagggccagtcagaatgttaagagccactccttagcctggtaccagcaaaaacctggaccagcctcccaggctccctcatctatggtgccgtccaccgagggccacgtggcactcccagacaggttcagtggcagtgggtctgggacagacttcactctcacatcaccagctggacncctgatgtatttcgacgtagtttcgtttttactcgttacagttacgtagttagttacgggtaactttccgaccgttacgggtactaacggtttaccgggaccgtaacggggggtaacccctaaaggggtttacggaaaaacgttaccgaaaaccggtaacgttagggttaccgggacgtttaccggaacctaacccgtaacgtttccgttacggtttacccttaccgtaacgtttccccgttaccccggtaccc

SEQ ID NO: 107003 - DNA, 742 bp, Homo sapiens
  misc_feature: GYAE6OF02I9KUW.48.71.G05.1.454.CMB.1.raw
  modified_base (286)..(286): a, c, t, g, unknown or other
  misc_feature (286)..(286): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaaggggaagccgccaccctctccgtgtacgggccaggtcagaatggttaagacgccactcctagcctggtaccagacaaaacctgcagccnccaggctcctcatctagtggtcgcgtcccaccgacgggccctacgtcgggacctacgtccccaagtaaccgtacggtttacctaagggtcggacgtacggttcgggggtccgtacggggactaacggtacctttaccgaccgttcctaccgaaccctacgttacccaacccgtacgtaaccggtcgggacgtacccgtagggtacgtttaggttaacgttttcgggaactttacgggttttacgtttttttccgacgttacgaacgttccgtaagggttaacgttacgggtaacgttttacccgtaccggttaaccgtaccggttacgttacccgggacgtaacggggtaacccgtaagggtacgaaacgtaaccgaacgtacgtcggtacggtacacggtaccacgtacgttccgtacgttaccgttccgtaaccgttttccgtaccccgtaccg

SEQ ID NO: 107004 - DNA, 639 bp, Homo sapiens
  misc_feature: GYAE6OF02HHIYL.48.71.G05.1.454.CMB.1.raw
  modified_base (205)..(205): a, c, t, g, unknown or other
  misc_feature (205)..(205): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacacccaccggagaaattgtgttgacgcagtctccaggcaccctgtcttgtctaccgaggggaacncgccaccctctactggtacggccagtcaagaattgttaaagagcccacgttccttagcctacggtaaccagaaccaaaaaccgtgaccacgccctaccgaggcctccctacatcctagtcggtcgccgtaccaccgacggcctagtcgccactccaaggtacgtacggttcaggtcgcgtaggtcggtacgtcggaactagtaccttcgacctactaccaactactaccaacgacgtacgtcggtactcgtagacgttagttacttgacgttagtttcttttcgacgttcaagtcttaggtacgtaggtacttacgtaccgtacgtacgttacgtccgggacgtaaggggtaactaaaggtagtaaaccgaacgtaacgagttacggcgaactgacctacagtccttacggtcctaacgacttccgtacccacg

SEQ ID NO: 107005 - DNA, 705 bp, Homo sapiens
  misc_feature: GYAE6OF02F7M0J.48.71.G05.1.454.CMB.1.raw
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaaagcgcccaccctctcctggtacgggccaggtcagaatgttaagagccactccttagcctaggtaccagaccaaaaaccgtcggaccacgccctcccacggtcctcctactactctagtggtcgccgtccaccgtacgggcccacgtcggaccactcccgagaccgtaggttcgaggtggacgaggtcgggtacgtcgggactaacgtaccttcaaccgttcctacccaaccctactaccgaaacccgtacgtacgtacgggaccgtaccgtagacttacggttagtttacggacttagggttttcgtttttcgtacgttcgtacggtacgttaagtacgttaggtacgttaccgaccgttacggacgtacgtttcccggaccgggtaaccggggtaaccgtaagggtaacggtaacctaacgtaacgtaacgtggtacggtacgtacgtaacccgtacgtacgttcgttagttcccttacttaccttcccgttacccgtac

SEQ ID NO: 107006 - DNA, 708 bp, Homo sapiens
  misc_feature: GYAE6OF02JCFN4.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgtctccgaggggaaacgccgccaccctctccgtggtacgggccagtcaagaactagttaagacgccactcctagcctggtaccagacaaaacctggccacgcctccgaggcctcctcatctagtcggtcgccgtcctaaccgcggacctacgtcggccacctccgaacgtaccgtacggttacacggttcggacgtacggttcgggtccggtacgggaacctaacgggtacccttacggtaacccttacctaccgtaaacccgtacgttacccaaccgtacgtaccggtacggtaaccgtccgtaaggtaaccgtcggtttaacgtttggaccttacggttttcgttttaccgtggtactaggtcgtaaggttagtacggtagttaccacggttaccgtactcgtaccgggtaccgtaggggtaccgaaaggtacgtaaacgtaccgaacgttaaccggtggtccggacgtcgaacctacgtgtacgttcttaccggttcctacgtcccttaccggtac

SEQ ID NO: 107007 - DNA, 816 bp, Homo sapiens
  misc_feature: GYAE6OF02FF3VM.48.71.G05.1.454.CMB.1.raw
  modified_base (201)..(201): a, c, t, g, unknown or other
  misc_feature (201)..(201): n is a, c, g, or t
tcagagtatacatacacgaccggtgctcgatttagtgtcgtcgcaagagagagggggaagagctgctcagttaggacccagagggaaccatcggaaaccccagcgcagcttctcttcctcctgctactctggctcccagacaccacggagaaattgtgttgacgcagtctccagcaccctgtctttgctaccgagggaacnccgccacctctccgtgtacggccagtcagaattgtaacgacgccactccttagccctaggtaccagtaccaaaacctggccacgcctccaggcctccgtcatcctatcggtcgccgtaccgacgacggtccaacgtggcctaactcccgaagtaccgtaggtttccgagtcggacgtacggttcgggtcgtacgggactacggtacctttaccgaccttaccgtaccctaaccctaacgttacccgaaccgtacggaaccgtttacgggaaccgtacccgttaggtaacgtttacggtttaacttttcggaacgtttaaggttttccggttttaccgttacgttaccgtacggttaacgttaacggttacgttaacgggtaaccgtttaccgtaaccccggttacgggtaaccgttaaccggtttacccggggaacccgggttaaacgggggtaaacccgttaaaaggggttaccggtaaaaccgtaaacccggttaaaccggtacgttacggggttaacgaccgggtttaaccacccggtaaaccttacggtttaacccgttcgggtttaacccctttaccgtacccgtttaccccggtttacccgtaacccgg

SEQ ID NO: 107008 - DNA, 547 bp, Homo sapiens
  misc_feature: GYAE6OF02GZEL4.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaancgccaccctctcctgtagggccagtcagaatgttaagagccactccttagcctggtaccagcaaaaacctggccagcctcccaggctcctcatctatggtgcgtccaccagggccactggcactcccagacaggttcagtggctaggtgggtctgggacagtacttcactctcaccagtcaccagacgtggacgcctgatgtatttgctagttgtttttcagttcagtctagtagtaggtattcgacgttcgactacgttccggacgacggggtaacaaggtagaactacgaacgtataggtcgactagaccactatcttacgtcttacacttccgtcctaccg

SEQ ID NO: 107009 - DNA, 827 bp, Homo sapiens
  misc_feature: GYAE6OF02H6YDO.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctgctcccagacaccaccggagaaattgtgttgacgcagtctccaggccaccctgttcttttctccgacgggaaaggacgcccaccctccttcctcgtacgggtccgacgtcaagtaacttagttaagtaacggaccaccttaccttaacgtccgtcggtaccgacaaccgaaaacctaccggtaccgaccgtacccgtcccctacgtacccgttcctacctagtcttacgttggtcgtaccgtccgaacccggacgggtacccgtacctacggtccacgtacccgaccggtacgaacggttacggtaggtacggcgtacgggtcgggttacgggtcgggtacgtaacgtaccgtttactacccgtaccgttccaaacccgtaccgtaaccgtaaccccgaacggttacccgtaccgggtaacggttccctaacgggttacttacgggtttaacgttttaacggtcgttaaagggttccgttttaaacggtttaccgttacgttacggtacgttacggagtttaaccgagggtttcaacgtcctaaccttaccgaccttaccggttacctacggggttaccgggaacgggtaccgtagggtacgggagttaaccgtaacgtaaacccggttaggttccggtacgttacgtaccggtaccgtcgttacccgttaggttccgttttaccgttctttacccg

SEQ ID NO: 107010 - DNA, 635 bp, Homo sapiens
  misc_feature: GYAE6OF02I7DM6.48.71.G05.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtaggccagtcagaatgttaagngccactccttagccctaggtaccagacaaaacctgaccagcctccccgaggcctcctcatctagtggtagccgtaccaccgacggccacgtggcactccagacgtagttcgagtcggacgaggtggtcgtagggacagtacttcactctaccactacgtacaaccgagacgtggaccgtacctagacttgtagttttcgacgttgttttcttttcgtcgttagtacgtcttagttagttacggtaacgttcgtaaccgttcggtaacgttacgttaccggaccggtaagggtaccgtaaagggtaacgaattaaccggaaacctaggttacggtcggtactcgtaacctaccgtacgttcgttcgtttaccttccgacctttcccgtcccgtaccg

SEQ ID NO: 107011 - DNA, 612 bp, Homo sapiens
  misc_feature: GYAE6OF02I5G4O.48.71.G05.1.454.CMB.1.raw
  modified_base (202)..(202): a, c, t, g, unknown or other
  misc_feature (202)..(202): n is a, c, g, or t
  modified_base (336)..(336): a, c, t, g, unknown or other
  misc_feature (336)..(336): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcacctgtctttgtctccgagggaancgccacctctcgtgtagggccagtcaggtaatgttaacgacgccaactccttagcctggtaccatcaagaaacctggccacggcctcccaggcctcctcattcctacggtgcactccgaagccgagggccacgnggccaactcccgagaccgtagttccgaggtcggcaggtgggtcgtgggacacgtactccgtctactccaccgtcaacgcgacgtactcggacctaggaagttgtttgctaggtcttattactgtcagtcgtaatcgtggtacncgtaccgaccgtnacctccgttcccgaggaaccggtacgaccgtacgttagggagttaaaccgttaaccgtaacgtacgggtaccggtactccggtaaccacgttacgtccgtttcggttccttacgtacccg

SEQ ID NO: 107012 - DNA, 727 bp, Homo sapiens
  misc_feature: GYAE6OF02HEDU0.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaccccagcgcagcttctcttcctcctgctactctggctccagacaccaccggagaaattgtgttgacgcagtctccagcaccctgtctttgtctccgaaggggaacnccgcccacctctccgtgtacgggccagtcagaatgttaagagtccactcctacgctaggtacaagaccaaaaaccgtggaccacgccgtaccgaggtcctcctctatctagttcggtctccggtaccaccggtacggccctacgtcggtccactccgaagaccgtaggttcacgggttcggacgtacggttcggggtcgtacggggaacctacggtaccctttacgaccttacctaccgtaacctacgtacccaacggtaccgtaacggttacggaccgtacccgttaacggtaagttcgttttaacgttttacgtacggttacggtttttcgttttttcccggtgttaacccgtagttacgtacgtttacggtacggttaaccttaccgtaccgttacggtaccgttacggccggtaacggggaacggacggtaaaggttacgaaaactacgtaacggtacgtacggacgtccgtataacccgcttagtccgttcttaccgtcctacggttccctacccggtac

SEQ ID NO: 107013 - DNA, 640 bp, Homo sapiens
  misc_feature: GYAE6OF02H5DUU.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtccagaatgttaagacgccactccttagcctaggtaccagacaaaaacctggaccagcctaccaggctcctcatctaatggtcgccgtccaccgaggccactgcactcccagactaggtccagtggctagtgggctgggacagactacactctacacctataccaacgtacgacgtggaagtcctagtatagttaacttttgaccgtaaggtttcgtttttactgttacgaagctaaggttagtacggtaacgttcctaaccgtcggaactacgttcggaccgtaaacgggggtaacctaagggtaacgtaaacgtaaccgaaaccggtacgtacggtacgggtaccttagggaccctaaccgtaacgttacctcgttactttacccgtaacgtttccccttaccccggtacc

SEQ ID NO: 107014 - DNA, 601 bp, Homo sapiens
  misc_feature: GYAE6OF02HUAGS.48.71.G05.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtaggccagtcagaatgttaagngccacttccttagcctggtaccagcaaaaacctggccagcctcccaggctcctcatctagtggtgcgtccaccagggccactggcatcccagacaggttcagtggcagtgggtctggacagacttcactctcaccatcacacgactggacgcctgatggtattttgactagtttgtttttctcgttactagctagttataggtaacgtttcaccgttacggactacgttccggaccgtaacggggtaacctaaagggtacggtaaactacgtaaaccgtaacgttaggtacgggtaccttacggacctaaccctacgttccgttacgttccctttaccgtacttcccgtttaccccgtaccg

SEQ ID NO: 107015 - DNA, 553 bp, Homo sapiens
  misc_feature: GYAE6OF02FI873.48.71.G05.1.454.CMB.1.raw
  modified_base (203)..(203): a, c, t, g, unknown or other
  misc_feature (203)..(203): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagaatgttaagagccactccttagcctggtaccagacaaaaacctggccagcctcccaggcctcctcatctatggtcgcgtccaccgagggcccactcggcactccccagacaggttcaggtcggcaggtgggtctgggacagtactcactctcaccntcacagctggacncngatgtattgctagttnttttactntcagtcagttataggtacttcaccgtaggtactagttccggaccgtacggggacctaaagggtagaactacgaacgagtggtcggctacgacctacattcgtactcgttactcttaccgtccgtacc

SEQ ID NO: 107016 - DNA, 661 bp, Homo sapiens
  misc_feature: GYAE6OF02FM4JY.48.71.G05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaangccactcttagcctgtaccagacaaaacctggccagccctccaggcctcctcactctatggtcgccgtaccaccgacgggccacgtggcactcccagtacaggtcagtcgcgaggtggtcgtgggacaggtactttcgacttctcgacctactccaccagaccgttgggaacgtccgtaggtacgttagttacgttttcgcgtttaaggttttcgtttttacgtgttactacgggttacttaggttaacgttacggtaacggtttaccgtaccgttaccggtacgttaccgtttcccgggaacccggtaacgggggtaaccctaaagggttacgtaaaccgttaccgaaaacgtacgtacggtacggccttacggacctaccgtattcgtcgttaccttcctacgttacccgttcccgacg

SEQ ID NO: 107017 - DNA, 671 bp, Homo sapiens
  misc_feature: GYAE6OF02H6J5Q.48.71.G05.1.454.CMB.1.raw
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (453)..(453): a, c, t, g, unknown or other
  misc_feature (453)..(453): n is a, c, g, or t
  modified_base (546)..(546): a, c, t, g, unknown or other
  misc_feature (546)..(546): n is a, c, g, or t
  modified_base (557)..(557): a, c, t, g, unknown or other
  misc_feature (557)..(557): n is a, c, g, or t
  modified_base (566)..(566): a, c, t, g, unknown or other
  misc_feature (566)..(566): n is a, c, g, or t
  modified_base (580)..(580): a, c, t, g, unknown or other
  misc_feature (580)..(580): n is a, c, g, or t
  modified_base (602)..(602): a, c, t, g, unknown or other
  misc_feature (602)..(602): n is a, c, g, or t
  modified_base (623)..(623): a, c, t, g, unknown or other
  misc_feature (623)..(623): n is a, c, g, or t
tcagagtatacatacacgaccggtgctcgatttagtgtcgtcgcaagagagagggggaagagctgctcagttaggacccagagggaaccatcggaaaccccagcgcagcttctcttcctcctgctactctggcctaccagacacccgacggagaaattgtcgttgaccggacagtcctaccgaggcctacccgttgtccgttttagtccgaaccgaggggtaacnccgtacccacccttctccgtggtaccgggccagtcgaagtaattcggtaaagcncctactaccgttagccttacgggaccaacgaccgtaaaaccgtcggaccacgtccctaccgacggtcctaccgtctataccgtgtcggtcgtcctacccgaaccgtacggaccctaccgtcgacctaccgtaccacggtacgtaacggtcgtaggcgtacgtacggttcgggtntacggtacacgttacgtccactcgtaacctaccagtaccacgacgtcgtacgactacgtagtaatcgtagtttcgacgtttacgttgtttacncgtagaccgtntaccgtagnggtactcacggtcncgtacgtccgacgtcgaaccgnttaacgacttacagtcgtagngctaacgcctacgacgttcgttacgccttacgtacctcgtcccgtaag

SEQ ID NO: 107018 - DNA, 586 bp, Homo sapiens
  misc_feature: GYAE6OF02GQ6J8.48.71.G05.1.454.CMB.1.raw
  modified_base (202)..(202): a, c, t, g, unknown or other
  misc_feature (202)..(202): n is a, c, g, or t
  modified_base (406)..(406): a, c, t, g, unknown or other
  misc_feature (406)..(406): n is a, c, g, or t
  modified_base (552)..(552): a, c, t, g, unknown or other
  misc_feature (552)..(552): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaancgccaccctctcctgtagggccagtcagaatgtaagagccactccttagcctggtaccagacaaaacctggccagcctccaggctcctcatctatggtcgcgtccaccgacgggccacgtggcactcccagacgtaggttcagtggcaggtcgggtcgtgggacagtacttcactctcaaccactccaccgacgacgtaggacncctgactgtatttcgacttaggtttgtttttcgcgttcgagtacgtagttacgtaggtaacgttcaccgttacggactacgttaccggacgtaacggggaaccaaggtacgaactacgaacgtacgtgtcggctacggaccacgtntacgttgtaccttcctacgttccctacccgtacg

SEQ ID NO: 107019 - DNA, 587 bp, Homo sapiens
  misc_feature: GYAE6OF02FGBIQ.48.71.G05.1.454.CMB.1.raw
  modified_base (204)..(204): a, c, t, g, unknown or other
  misc_feature (204)..(204): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaacnccgccaccctctcctgtacggccagtcagatgttaagagccactccttagcctggtacccagaccaaaaacctggccacgcctccaggctccgtcatctatggtgcgtccaccgacgggccacgtggccactcccagacaggttcagtgcngtggtcnggacagactcacgtctcgaccatcaccagacgtggcnccgtgagtgtatttgactagttnttttcgtgttctacgtcgtagtagtaggtacttcaccgtcggtactacgttcggaccgaaggggtacctaagggtacgtaaacgtacgaaacgtaacgtggtcggctaccggtccaaccgtacttacgttcgttaccgttactaccgttccgttacccgtacccg

SEQ ID NO: 107020 - DNA, 575 bp, Homo sapiens
  misc_feature: GYAE6OF02GJDN4.48.71.G05.1.454.CMB.1.raw
  modified_base (203)..(203): a, c, t, g, unknown or other
  misc_feature (203)..(203): n is a, c, g, or t
  modified_base (368)..(368): a, c, t, g, unknown or other
  misc_feature (368)..(368): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaaacncgccaccctctcctgtagggccaggtcagaatgttaagagcctactccttagcctggtacccagcaaaaacctggcctagcctcccaggctcctcatctagtggtgccgtccaccgacgggccactgacatccccagacaggttcagtggcagtgggctgggacngacttcactctcaccatcaccagctggactcctgatgtatttgactagttgttttctggttcagctagtacgtgtaaagtttccaaccgtcggaactacgtttacggcccgtaggggaacctaagggttacgaaactacgaaaccgtacgtggtacggtctcggaccaacgtcgtaccgtgttcttaccactttcccgttccccgac

SEQ ID NO: 107021 - DNA, 686 bp, Homo sapiens
  misc_feature: GYAE6OF02ILP2Q.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccagggaaagcgccaccctctcctgtagggccagtcagaatgttaagagccatccttagcctgtaccagacaaaacctggccagcctccagctctcatctatgtgcgtccacgcggccacgtggcatcccagactagttcgacgtcgacaggtcggtctacgggacagtacttcaccgtctacgacactaccaaccacgtacgtacggacgtaccgtgaacgttagtaacgtttttcgtacgtttaagttttttttcctcgttactaacggtaccttaacggttacgttaagggttaacctttaccggaccgttaaccggtaaccgttacgtttaccgggtacccggtaacgggggtaaccgttaaacgggtaacgtaaaacgttaccggaaaaccgttaccgagggttacggcgtaccggaccttaacccgtacgttaccgttcgtttacccgttaccgttaccgtttacccgttaccccggtacctaaccgg

SEQ ID NO: 107022 - DNA, 713 bp, Homo sapiens
  misc_feature: GYAE6OF02IFJQG.48.71.G05.1.454.CMB.1.raw
  modified_base (281)..(281): a, c, t, g, unknown or other
  misc_feature (281)..(281): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagccgccaccctctcctgtacgggccagtcagaatgttaagagccactcctagcctggtacagacaaaacctgccagccnccagctcctcatctatggtcgcgtccaccgacgggccacgtcggcactcccagacaggttcaggtcggacgacggttcgggtactcggggtaacacgtaccgtttaccgaaccttccttaccaacccgtattacccaaccgtacggtaaccgtacgggtacgtacccgttggtaattagttaacgttttttcggacgtttacggttttacgggtttttttcttacggttacgttacgtacgtaagttacgtacgggttaaactttccgaaccgttacggtaccgtacggtttccggaccggtaacggggaacccgtaaagggtacggtaaacttaccgaaaacgggtaccgttacggtacggtaccgttcggaacctaaccgtacgttccgttacgtttaccttaccctaacggttccccttacccgtaccg

SEQ ID NO: 107023 - DNA, 779 bp, Homo sapiens
  misc_feature: GYAE6OF02GCKAD.48.71.G05.1.454.CMB.1.raw
  modified_base (500)..(500): a, c, t, g, unknown or other
  misc_feature (500)..(500): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcacctgtctttgtctcgagggaacgccgccacctctcgtggtacgggccacgtacagtattagtaagacgaccacttaccgttagcctaggtaaccaagaaccgaaaacctcggaccacgccctacccgaggtcctacctactactcgttacgtgggtcgtccgtacccgaccgtaccggtacctacgtacggacctaccgtacccgaacgaccgtacggttaccgaggtcggacgtaggttcgggtcgtacgggactacgtaccttcgtacctacgtaccacctacgtccgaacgtaacgtacgtacgggaaccttaccggtntacggttacgttacgtttccggtacgtttcgtttccgtttttcgaggttaccgtacggttaacgttacgtttaaggttaccggttaaacgttccgtaaccggttacggttaaccgtaaccggttccgggtaaccgggaaacgggtacgttaaaacgggtagttaaaaccgggtaccgtaaacggttaccgtcgggttccgtaacccggtcggtaaccctacggtttacgttaccggtttaacttccgtttaaccgtacccttttccccggtacctaccg

SEQ ID NO: 107024 - DNA, 907 bp, Homo sapiens
  misc_feature: GYAE6OF02JRRY4.48.71.G05.1.454.CMB.1.raw
tcagagtatacatacacgaccggtgctcgatttagtgtcgtcgcaagagagagggggaagagctgctcagttaggacccagagggaaccagtacggaaaccccgagcgcgacgtcttcctcttcccttcctcgtcctactccgtcggcctacccagaccacccgacccggaagtaaagttcgttggttacgaccggctaggtcctccgaaggtccctaacccgtcggttccttttgtcccgtacggaaggggtaaacgcccgaccccgtacccttccgtcccgtaggtacccggggtaccctaggttaccgaaggtaaccgtttaggttaaacggacccggaccctaaccgtttcccgtttaccggacccgtttcgggtaacccaacggtaaacccctaaaaacccggttcgggaacccaccggtaccccgtaccccgaacggccccttccctaccggtactttaccgtcgtcgggttaccgcccgttacccaaccggccggtaccgtactcggacctaccgtaccgacgtaacggttacgggttaccgtaacgggtcggtaaccgtggggttccgggtaccggtttaacggggaacccttaacgggttccctttaccgtaaccgtccgttaccctaacctagaccccgtacgtaacggtacgcgggtacgtaccggtcgtaacgttacgtacgttttacggaccgtttaggttttccgtttacgttgttaccgtacgtacgtacgtaggttacgtacgttaccgtacgtccgtacgtccgttaccgggtacggacgtaacggtaacggaacgtaaccgttaccgacggtacgtacgggtcggaccttacggccgtaacttacgttaccgtacgttaccgttacgtcccgttaccgtaccccgtacg

SEQ ID NO: 107025 - DNA, 722 bp, Homo sapiens
  misc_feature: GYAE6OF02JCI4K.48.71.G05.1.454.CMB.1.raw
  modified_base (213)..(213): a, c, t, g, unknown or other
  misc_feature (213)..(213): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggcctcccagacaccgaccggagaaattgtgttgacgcagtctccaggcctaccctgttctttgtccgtaccgaaggggaacnccgccacctctccgtggtacggccagtcaagtaacttgtaagcgcctacttccttacgccgttacggtaccagaacctaaaaccgtcgaccgtacgccctaccgacggtcctccctacgacttcgtacgtcggtcgaccgtccgaccgacgggccctacggtcggacctactacccgatacggtacgttcgaggtcgacggtaggtcggtagtacgggactacgtactcgactccgtaccacctacgtaccaaccgtacgacgtgaccgtaccgtgggtaacttcggttatttacggtacgtttaggtttttaccgttttcgtaacgtcgttaacggtcgttagtttacggtacggttaaccgttccgaaccggtttcgaacggttacgttcccgggtacgggtaacgggtaccgtaaagttaacgggtaacttaacggacgtttacggcgttacggacgtaccgaacctcgtacggtcttcgtacctacgtcccttacccgtacctcg

SEQ ID NO: 107026 - DNA, 744 bp, Homo sapiens
  misc_feature: GYAE6OF02GO6M0.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaanccgccaccctctcctgtacgggccaggtcagaatcgttaagacgccacttccttagcctggtaccagacaaaacgtcgccagcctccaggcctacctcactctaagtcggtagccgtccaccgacgggtccacgtcggcacgtcccgagacgtaggttcagttcgcgacgtggtctagggactacgtacgttcacgtacctcgaccatccgaacgtacgtacgtacggtaacgcctagtacgttacgttaacgttttcggacgttaggttttaccggtttttacgtcggttaccgttaaggttcccgttaaggtttacgttacgggtaaaccgttttccgtaacccggttaccgggtaacccttacgggtttacccggacccgggtaaacgggggttaacccgtaaacggggttaaaccggtaaaccgttaaccgtaaaaccgttaacggtaccgggttacggtacgttacccggtaccgaaccgtttacgtaaccgtttcggttacctttaccgtaaccgtttcccgtaccccgtaaccg

SEQ ID NO: 107027 - DNA, 741 bp, Homo sapiens
  misc_feature: GYAE6OF02HHI35.48.71.G05.1.454.CMB.1.raw
  modified_base (202)..(202): a, c, t, g, unknown or other
  misc_feature (202)..(202): n is a, c, g, or t
  modified_base (387)..(387): a, c, t, g, unknown or other
  misc_feature (387)..(387): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccaccctctcctgtagggccagtcagtaatgttaagacgccacttccttagcctggtaccagacaaaacctggccacgcctcccgaggcctcccgtctagtctacgtggtacgccgtacccaccgacgggcctaccgtggccacgtcccagaaccgtaggttcagtcggactaggtgggtcgngggtaccagtaccttcgacttctaccgaaccctatccgaaccctaggaccgtaggacgtcccgttaggattggttacgttttcggtcgttacgggttttacgtttttcgtcggtttacgacgttaccgtaaggtttacgtacgggttaacgttccgtaacccgttccgggtaaccttccggttacccgggaccgggttaacccggggggtaaccgttaaacggggtaacggtaaacgtaacccggtaaaccgtaaccggttagggttaccgggtaacggtttacggaacccgtacccgttaattcccgttaccggtttccttaccggttaaccctttcccggttacccctaccg

SEQ ID NO: 107028 - DNA, 591 bp, Homo sapiens
  misc_feature: GYAE6OF02HNM6B.48.71.G05.1.454.CMB.1.raw
  modified_base (293)..(293): a, c, t, g, unknown or other
  misc_feature (293)..(293): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (457)..(457): a, c, t, g, unknown or other
  misc_feature (457)..(457): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtcttgtctccgagggaagcgccaccctctcctggtacggccagtcagaatgttaagagccacttccttagcctaggtaccagacaaaacctggccacgcctccagctccncactctatggtcgcgtccaccgaggccacgtcggacactcccagacaggttcagtcggctagtggtcgtagggacagtactcacnctcacnctcacngacgtgactctagatagtatttcacgttagtttcgttagtgtacgtagacttagtgtagtacttacncggtacgtagtaccgtcggacgacgggtaacccgtaagaacggtaaactacgaaacgtcggtacggtaggtacctacggacctaccgttacgttccgtagttccttaaccgttaccttcccgtaccccgtaacc

SEQ ID NO: 107029 - DNA, 678 bp, Homo sapiens
  misc_feature: GYAE6OF02HVCA4.48.71.G05.1.454.CMB.1.raw
  modified_base (333)..(333): a, c, t, g, unknown or other
  misc_feature (333)..(333): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagccgcccaccctctcctggtacgggccagtcaagaatgtaagagccactccttacgcctaggtaccagacaaaacctggaccagccctaccgaggtcctcctcatctagtcggtcgcgtccacgcggccncgtgcactcccagacgtaggtacgaggtcggcgtaggtcggtcgagggacacggtaccttcaccgttctaccgacctacgtcccaacgtaacgtacgtacggacgtacgtagtatggtttatttcgacgttaaggttacttaacttacgttacgtacgagtaccgtaagtacgtacggtacgtcctaaccgtacctacgtaaccgttaccgttacgggttccgggaacggtaaccggtacgggtaacgggtacggaacggtaactaaaccggtaaaccggttacggttacggtacgtacgtaccgaccgttaccgtacgtttaccgttacttacccttaacccgg

SEQ ID NO: 107030 - DNA, 659 bp, Homo sapiens
  misc_feature: GYAE6OF02GCCAK.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaacttgtgttgacgcagtctccaggccaccctgtctttgtctccgaggggaacncgccacccttctccgtgtacgggccagtcagaactgtaagagccactcttagcctggtaccagaacaaaacctcggaccacgccctccgaggtcctccctacactacctagtggtcgccgtccaaccgacgggtccacgtcggccacgtcccaagacgtacgggttctaaggtggctaggtcgggtacgtacgggacacgtacgttacaacttaccgtaccactactaccgaaccgagtaccgtggaactccgtagattacgtaagttttcgacgttagttttcgttttactcggttacacgtataggtagttaggttaaccttcgacccgttacgacgtacgtccgggacgtaacgggtaacaagggtaacgaacgaccgtaaagtaccgttacggtcggtacgtacgaccgtacgtacgttcgttcgttaccttcgactttccctacctac

SEQ ID NO: 107031 - DNA, 608 bp, Homo sapiens
  misc_feature: GYAE6OF02FVT7Q.48.71.G05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (403)..(403): a, c, t, g, unknown or other
  misc_feature (403)..(403): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgctccaggggaancgccaccctntcctgtacgggccagtcagaatgttaagcnccactccttagcctggtaccagacaaaacctgccagcctccaggcctcctcatctatggtcgcgtccaccgaggccacgtggacactcccagaacgaggttcagtggacaggtgggtctgggacagacttcgactctacaccataccaccagactgggacncctgaatgtattttgacgtagtttcgtttttcgtgttcagtactaaggttagttagggtaacttcgtaaccgtacggaacttacgttccggaccgtaagggggtaacctaaagggtacgaaattaccgaaacgtaactaggtcggacgttcgaacctacgtaacgttcgttacggttacctttacgactttcccgtacccgtacc

SEQ ID NO: 107032 - DNA, 688 bp, Homo sapiens
  misc_feature: GYAE6OF02F026A.48.71.G05.1.454.CMB.1.raw
  modified_base (382)..(382): a, c, t, g, unknown or other
  misc_feature (382)..(382): n is a, c, g, or t
  modified_base (431)..(431): a, c, t, g, unknown or other
  misc_feature (431)..(431): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattagtgttgacgcagtctccacggcaccctcgtctttgtctccgaggggaagacgccaccctctcctgtagggccagtcagaatagttaagagccactccttacgcctggtaccagacaaaaaccgtacggccacgcctcccacggacctcctcatctatggtgccgccaccgacggccacgtcggcactcccgacgacgtacgttcgagtggcgaggtcgggtcgngggacagtcttactactctaccacctacgtacaccgagacgtgggaacnccttagagttcgttatttgacgttatttgtttttaccgngttacgngttacgtaagttacggttaggtaacgttaccctccggtaacggtacctaacggttaccgggaccggtacgggggtaaacctaaggggttaaagaaaccttaccgtaaacgggaacgttagggtaccgggtcctaacggaccgtaaccccgttattacccggtttacggtttcccttaacccgtttaccggtttacccctcccccggttaac

SEQ ID NO: 107033 - DNA, 720 bp, Homo sapiens
  misc_feature: GYAE6OF02FFM6F.48.71.G05.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctcaggcaccctgtcttgctccgaggggaancgcccacctctcctggtaggccagtcagtattggttaacncgctacttccttagcctggtacccagaccaaaaccgtcgccagcctcccaggcctcgtcattctatggtgccgtccaccgacggtccaacgtcggccacctacccgagtaccgtacggttaccgagtcgggaccaggttcgggtaccggtgggaaccgtaggtacccgttactaccgtcccttaaccgacctaactacccgtaacgacgaaccgtaggggacctacccgttaggtaacgtttacggttacggttttacgtaccgtttacggttttagttttttaccggtggttaccgtaggttaccgtaagtttaccggttacggttaaacggtttacccgaccgttacggtaacccgtagtttcccgggaacggttaccggggaacctaaaggggttaaccgaaacgtacgtaaaccgaacggttcgtaacggcctaagacctactacgtctacgttacctcggtctccgtccctacg

SEQ ID NO: 107034 - DNA, 615 bp, Homo sapiens
  misc_feature: GYAE6OF02IN8DX.48.71.G05.1.454.CMB.1.raw
  modified_base (203)..(203): a, c, t, g, unknown or other
  misc_feature (203)..(203): n is a, c, g, or t
tcagagtatacatacacgaccggtgctcgatttagtgtcgtcgcaagagagaggggggaagagctgctcagttaggacccagagggaacccatggaaaccccagcgcagcttctcttcctcctgctactctggctcccagacaccaccggagaaattgtgttgacgcagtctccaggcaccctgtctttgtctccaggggaanccgaccaccctctcctggtacgggccagtcagaatgttaagacgccactccttagcctggtaccagacaaaacctgccacgcctccagcctcctcatactatggtcgccgtccaccgacggcctactcggcctactccccaagaaccgtaggttccagtcggcaggttcgggtcgtcgggacagtacttcactcacacactccaaccacgactacggactccgtagtattactagtttcgacgttgtttcgttttactcggttactacgacgttagtacgtaggtaacttccgtaccgtacgtacgtacgttccggacgtacgggtaaccgtaaggtacggaatacgaaccgtatcggacgtactacgacgtaactacgttcgtacgtccgttaccacttaccctccgtacc

SEQ ID NO: 107035 - DNA, 822 bp, Homo sapiens
  misc_feature: GYAE6OF02GIGRO.48.71.G05.1.454.CMB.1.raw
  modified_base (202)..(202): a, c, t, g, unknown or other
  misc_feature (202)..(202): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaancgccacctctcctgtacggccagtcagaatcgttaagacgccacttccttacgccgttaggtaccagaccaaaacctcggccacgccctccacggcctccctacactctagtggtacgccgtaccgaccgacgggcctacgtcggcctacgtcccgagtaccgtacggttacgacggttcggacgtacggttcggggttaccgtaggggacctaaggtaccctttacgaaccttcctaaccgacctaactaccgtaacccgtaacggtaccgtagggaaccgtcccgttaggtaacgtttacggtttaacgttttcggaccgtttaggtttttaccggttttttccgtacggttaccgtaacggttacgttaacgggtttaaggttaacgggtttaaccgttttacccggtaacccggttaccggttaacccgttacggtttaccggggaacccgggttaacgggggttaaacccgttaaacggggttaaaccgtaaacgttaaccggaaaaccggttaccggttagggttaaccggtacctacgggtaaccctaaccgttacgtttaccgttaccgtttaccgttaccgtacccgtttaccccgttaccccgttaaccg

SEQ ID NO: 107036 - DNA, 734 bp, Homo sapiens
  misc_feature: GYAE6OF02HOFSO.48.71.G05.1.454.CMB.1.raw
  modified_base (244)..(244): a, c, t, g, unknown or other
  misc_feature (244)..(244): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaagccgccaccctctccgtgtaggccagtcagtaatgtaaagngccactcttagcctgtaccagacaaaaacctggaccacgcctaccacggctcctcaactctagtggtacgccgtccaccgacgggaccacgtcggcactacccagacgaggttcaggtggactaggtgggtcgtagggacgagtaccttcacgtctaccaacctacgtccaaccaacggtaccgtagggacgtaccgtagaacgttgttagttttcgacgttaggttttacgtttttcgtaggttcgtaacgtacgttagttaacgtacgggttaacgttaccgtacccggtaccggtaaccggtacggtttaacccgggaaccgggtaaacgggggtaaaccggtaaacgggtaacgggtaaaacgtaaccgtaaaacgggtaacgttcggggttaaccggtaccgtacggtaaccctaacccgttacgttacccgttccggttaacctttaacccgttaccgttttacccggttaccccgttaacccg

SEQ ID NO: 107037 - DNA, 699 bp, Homo sapiens
  misc_feature: GYAE6OF02HFWFB.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctcaggcacctgtctttgtctccgagggaaagccgccaccctctcctgtacggccagtcagaatgttaagagcccactccttagccgtggtaccagaccaaaaaccgtcggaccacgaccctccgacggtcctccgtacactactagtggtcgccgtccgaccgacggcccacgtcggcctactacccagtaccgtaggttacacggtcggacggtacggtcgggtacgtacgggacgtagtacgttcacgttcctaccaccgactacccaaccgtacgtacgtcgggaactccggtagtacggttacgttatttcggtaccgttagtttccgttttcgttacgttcgtaacgtcgttaacgttaggtacggttaacggtttcccaaccggttggtaccgtaccggtccgggtaccgggtaaccgggtaacggaaacggttaacgtaactaccggaacgttaccggtaggtcggtactaccggtacacgttactacggttaccgttgttaccttacgttcccgtaccgtc

SEQ ID NO: 107038 - DNA, 803 bp, Homo sapiens
  misc_feature: GYAE6OF02IPM2C.48.71.G05.1.454.CMB.1.raw
  modified_base (209)..(209): a, c, t, g, unknown or other
  misc_feature (209)..(209): n is a, c, g, or t
tcagagtatacatacacgaccggtgctcgatttagtgtcgtcgcaagagagaggggggaagagctgctcagttaggacccagagggaaccatcggaaaccccagcgcagcttctcttcctcctgctactctggctccagacaccaccggagaattgtagttgacgcagtctcgaggccaccctgttctttagtcctccgaaggggaacnccgaccctaccctctccgtggtacgggcctaggtcagtaattcgttaagacgccctacttccgttagcctggtaccagaccaaaaccgtggaccacgcctaccgagcctccgtactactctactgactacactacccgacgacgggtacctacgtcggtcgtaccgacgccgtacggttacacggtcggtacggttcggtacgtacgggtacaggtacgttcgacgttctacgaaccgtacgtacgacggacgtacgaccgttacggacctaacggttcgttaacgtaaacggtttaatttttaaccgtaaagtttttaacgttaacgttgttaaccgtacggttaacttaacgggttaacgttaacggtttaaacgggtaccggttaacccgtttcccggtaaacggggtttttaccggaaccggtttaaaccgggggaaccggttaaacgggttaacgggttaaacgtaaccgggtaaacggttaccgtacgggttaccggtacgtacgggtaaccctaacggttacctttaccgtaagttttacccgtaccgtttaccgtaccccgttttacccgacccgtatttacccgg

SEQ ID NO: 107039 - DNA, 622 bp, Homo sapiens
  misc_feature: GYAE6OF02GCEBE.48.71.G05.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (466)..(466): a, c, t, g, unknown or other
  misc_feature (466)..(466): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaacncgccaccctctcctgtagggccagtcagaatgtaaagngccactccttagcctaggtaccagacaaaactcgactacgcctccaagcctacctcatactatggtgccgtaccaccgacgggccacgtcggcctactcccaggaacaggttcaggtggactaggtcgggtactcgggaactagtacttccactccgtacaacctagtaccaaccgagacctgggaactcctgactagtatttgacttaagttcgttttacngtacagtacgtagtagtacggaacttcaaccgtgtactacgtaccggacgtaacgggaacgtaaaggtaacgtaaagtaccgaaaacgtcgtaggcggtacgtacggtacctacgttactaccgttcgtaccttacgtaccttccgtacctaaccg

SEQ ID NO: 107040 - DNA, 757 bp, Homo sapiens
  misc_feature: GYAE6OF02IDD3Q.48.71.G05.1.454.CMB.1.raw
  modified_base (210)..(210): a, c, t, g, unknown or other
  misc_feature (210)..(210): n is a, c, g, or t
tcagagtatacatacacgaccggtgctcgatttagtgtcgtcgcaagagagaggggggaagagctgctcagttaggacccagagggaaccatggaaaccccagcgcagtcttctcttcctcctgctactctgctcccagacaccaccggagaaattgtgttgacgcagtctccaggccacccttgttctttcgtctaccgaggggaaacnccgcccacccttctccgtaggtacgggccagtcaagtaagttgttaaacgacgcctacgtccttacggccgtggtacccaagacctaaaaccgtcggccacgcccctaccgacggcctccctactacttctagtcggtcgaccgtccgaccgtcgggaccagtcggaccaccgtcccaggtaccgtacggttcgagtcgggacgtggttcggggtacgtacgggacacggttaccttacgtccttaccacctaaccgtctacccgaaccgtagtaccggtcggaccgtaccgttacggtagtttagtttacgttttcgggaccttttaagggttttccgttttttacgcggtttacgtacgttacgttaaagggtttcgtacgggttaaccgtttaccgtacccggttaccggttaacgttccggttaccggggacggaaccgggttaaaccggaaagggttaaccgtaacgtaaccgacgtaccgtggtaaccgcgtacgtaccgtacgtacttcgttacgtccttaccgtcgttcccgtacctcg

SEQ ID NO: 107041 - DNA, 812 bp, Homo sapiens
  misc_feature: GYAE6OF02FM4XL.48.71.G05.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccgganaaattgtgttgacgcagtctccaggcacctgtctttgtctcgaggggaancgccacctctcctgtagggccagtcagaatgttaagacgccacttcctagcctggtaccagacaaaacctgcacgcctccaggcctcctcactcgtacggtcgccgtacccgacgacgggacccacgtcggactacgtacccgaggaaccgttacggttcgtacggttcggaccgtaacgggttcgggttaccggttaggggaacctaagggtacctttacccggaaccgtttccgtaaccctacccgtaacgtttacccgaaacccgtaacggtaacccggttacggggaaccgttaccgtacggttaacgtttaacggttttacgtttttcggtaccgttttaacgggttttaccgttttttttacccgtacggtttcgtaacggttacggttaagggtttacgggtttacgggttaaaccgtttaccgtaacccgtttaccgggtacgtttaaccggtcccggggtaacgggttaccggggaaaccggttaaagggtacggtaaaaccttacggaaaccggttacgtagtacgggtactaccggacctaaccgttagttacccgtagtttacccgtagtaccgtttcccgttacccggacttaaccgg

SEQ ID NO: 107042 - DNA, 851 bp, Homo sapiens
  misc_feature: GYAE6OF02HLQX3.48.71.G05.1.454.CMB.1.raw
  modified_base (171)..(171): a, c, t, g, unknown or other
  misc_feature (171)..(171): n is a, c, g, or t
  modified_base (222)..(222): a, c, t, g, unknown or other
  misc_feature (222)..(222): n is a, c, g, or t
tcagagtatacatacacgaccggtgctcgatttagtgtcgtcgcaagagagagggggaagagctgctcagttaggacccagaggaaccatggaaaccccagcgcagtcttctcttcctcctgctactctcgctaccagaccaccgaccggaagtaaacttgtgttacgacncgtacgtcctacgagcctacctgttcctttgtccgtacggaaaggggaacncccgtacctacccgttctcgtaggacggcctagtacaagtaagttcggttaagccgacctacgttccgtaacggtccgtaacggtaaccaaggaaacctaaaaaccgcgaccgacgtacccgtacgaacggtcctaccgtacgtacttacgtaacggttcggtaccgtaccgttaccaaccggtacggtacccgtaacgtcggtaacctaccgttacccggaacgtacggttaaccggtttacgacggttaccggacgtacggttaccgggtaccgtaacgggtaccgtaacgttacccgttacgtacccgtacgtaaccctacgtacgtaaccgaaccgtacggttaccgtacgggaaccgtccgtaggttaacgtacggtttaacgtttacggacgtttacgttttacgggtttaacctaggtaccgtaagtacggttaacgttaagggtacgtaacgttaccgacggtacgtaaccgtttgggaccgtaaccgggaacggtaccgtaaagggttaaaccgaagtaaccggtacgtaccgttagggtcccgtaacggtacctaaccggtaactttacgttacgtttacccgtaagttacccgtaacgttttaccccgaccggttaac

SEQ ID NO: 107043 - DNA, 849 bp, Homo sapiens
  misc_feature: GYAE6OF02G3YZF.48.71.G05.1.454.CMB.1.raw
  modified_base (247)..(247): a, c, t, g, unknown or other
  misc_feature (247)..(247): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtctttgtctccgaggggaaacgcgcccaccctctcctggtacgggccagtcagaatgttaagngccactccttagcctggtaccagaccaaaaacctggaccacgcctcccgaggcctcctacactctagtggtcgccgtccaccgacgggcccacgtcggaccactccccgaagaccgtaggttccgacggttcgggaccgtacggttcggggttaccgtacgggggaaccgtaacggttaacccgttaccgttaccgttacctacccgaaacccctaacgttacccgaaccccgtaagggttaacccgttacggggaaccgtacccggttaacgggttaactttacgggtttaacgtttttacggaccgtttaagggtttttcgttttttcccggttacgtttacgtacggttaccgttaacgggttaacgtttacgggttaaacctttcccggtaacccgttacccgggtaaacgttacccggtttacccgggggtaaccggtaaacgggggtaaacccggttaaaaggggtaacggtaaaacgtaaccggtaaaacgggttaaccgtagggttaaccgggtaccgtaaccgggtaccaaccgttaacgttaccgttacggttaccctttaccggtacccgtttcccgttacccgtaacccg

SEQ ID NO: 107044 - DNA, 712 bp, Homo sapiens
  misc_feature: GYAE6OF02I9RQ3.48.71.G05.1.454.CMB.1.raw
  modified_base (242)..(242): a, c, t, g, unknown or other
  misc_feature (242)..(242): n is a, c, g, or t
  modified_base (295)..(295): a, c, t, g, unknown or other
  misc_feature (295)..(295): n is a, c, g, or t
  modified_base (658)..(658): a, c, t, g, unknown or other
  misc_feature (658)..(658): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaaccggagaaattgtagttcgacgcagtactccaggcaccctgtctttgctcagggaagcgccacctctcctgtagggccagtcaggaatgttaaagngcctactcctagcctaggtaccaggacaaaacgtggaccacgcctaccagtcnctctatctagtcgtcgagtcccacagggaccctagtcggctacgtaccaacggacgtagttccgagtacggcctaggttgggtactacggggaacaggtaccctttcggacctttactaccaaccccgtacgtaacgtaccccaaggttaaccgaccgggtaacggttaccctttacggaacgttagggttaactttttcggaaccgttacggttttttacggttttacctttaacggttccgttagttaccagggtttaacgttcgggtaaagtttccaacccggtttcgaaccgtttacgtaccggtaccgaacggggtaccgtaaagggtagaaacgttacctaacgaacgtccggtaanaccggttaggacctaacacttcgttacgaccctttcaaccttccgtaccccgta

SEQ ID NO: 107045 - DNA, 719 bp, Homo sapiens
  misc_feature: GYAE6OF02GVFKL.48.71.G05.1.454.CMB.1.raw
  modified_base (505)..(505): a, c, t, g, unknown or other
  misc_feature (505)..(505): n is a, c, g, or t
  modified_base (692)..(692): a, c, t, g, unknown or other
  misc_feature (692)..(692): n is a, c, g, or t
  modified_base (702)..(702): a, c, t, g, unknown or other
  misc_feature (702)..(702): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtcctaccaggccaccctgttctttgtcctacgagggaaacgccgcccaccctctccgtgtacggccagtcaagaatgtaagcgccactccttagcctagtaccaagacctaaaaaccgtccgaccacgtccctacccgacggccttcctacagtacctaagtcggtacgccgtacccgaccgtacggccacgtcgccacctaccgacgtacgtacggttcgacggtcggacgtacggttcgggtacgtacggggacctacgaccgtttctaacccgttccgtacctacccaccgtacccgaccgtaacggtaccggttcgaacggtcctaaacggtnttacggtttaactttcggtacgttacggtttttcggtttttcgtaaccggttcacggttcgttaagttacgttacgttacggttaaactcccggtacgtccggttaacgtccgggtaaccgggaccgggttaacggaaggttacgaaacgttaaccgaccgttaggtacgacgtcgacgcgaccttntcgtcttacnccgtctccgtccgtacc

SEQ ID NO: 107046 - DNA, 858 bp, Homo sapiens
  misc_feature: GYAE6OF02IJSNJ.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctgcctcccagaccaccaccggagtaaattgtgttgacgcagtcctccgaggcctaccctgttctttgtctcgaaggggaacgccgcctaccctctccgtggtacggccagtcagtaactagttaacgcgccacgtcctacgccgtacgtaaccacgaacctaaaaccgtcggaccacgtcccgtaccgacggtcctcctactacttctagttggtcgcctaccgaccgacggcctacgtggccactacccgagaccgtacggttcacggttcggacgtggttacggggtacgtacgggtaacgtacgtacccttacaccgttaccacccgtaaccaaccgttaccaaccgtacggtaaccgggttaggacccggtcctaggtacgtttaaacggtttagttttccggtacgtttaacgggttttttcgtttttaaccggtgttacccggtaaacgtaccgttaagttaccgggttttaacgggtaaacctttaccccgtaacggtttaacccgggacttttaccggggttaaccgggaacccggggtaaacgggttaaacccgggttaaaccggttaaaaaggggtaaaacccttaaaccgggtaaaccggtttaccgggtacgggtaccggttaccgaccgggtttaaccgaaaccgttacggttttacccgtaccggttttacccgttacccggtaacccgtttttaccccccgtaccggtaacccg

SEQ ID NO: 107047 - DNA, 790 bp, Homo sapiens
  misc_feature: GYAE6OF02HWY12.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttagacgcagtctaccaggcacccgtgttctttcgtcctccggaaggggaaacgccgcccacccttctccgtggtacggccagtacgaagaattggttaaagacgaccctaccttccgttaacgccgttaggtaacccaagaacctaaaaaaccgtcggaccaccgcccttacccgacggtcctccgtactacttcgttagtcggtcgtaccgtacccgaaccggacgggacctacgtcggacctacgttcccgaagacgtacggttacgaggtcggcgtacggtcgggtcgtacgggacacgtaccttacacttccgtactaaccctactaccaaccgtacgtacgtacggaccgtcgtagtacgttagttacgttttaggaccgtttagttttccggtttttacgtacgttacgtagtacgttaagttacggttacggtaaccgtttacccgaaccggttacggtaccgtaaccggtttacccggggaaccggtaacgggttaaccgtaagggtaaccggtaaacgtaacccggtaaacgttccgtaagggtccggtacctccgtaaccgttacccgtacgtttcgttaccgtccgtttaacccgtacccggtttccctaacccgtcc

SEQ ID NO: 107048 - DNA, 663 bp, Homo sapiens
  misc_feature: GYAE6OF02GIENJ.48.71.G05.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (615)..(615): a, c, t, g, unknown or other
  misc_feature (615)..(615): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcaccctgtctttgtctccaggggaaanccgccaccctctcctgtagggccagtcagaatgttaaganccactccttagcctggaccagacaaaacctcggaccacgcctacccgaggcctcctcatctatggtcgccgtccaccgacgggcctaccgcggacactccgagacgacggttcaggtggacaggtcgggtcgtgggacagacttcgactctaccacactaccaccagtacgtggacgtcgtagtattcgttatttgacttaggtttcgtttttcgtgttcgtacgtacttaagtagttaggtacgttaccctaccgttacgtaacgttacgttccgggaccggtacggggtaaaccgtagggtaaacggtaaacgtaccggaaaccgtaccggtttacggtaccgggtacctacgggtaccaacccgtttnttacccggttcgttaccttaccgttaccgttacccgtccccgtaaccg

SEQ ID NO: 107049 - DNA, 821 bp, Homo sapiens
  misc_feature: GYAE6OF02GWE1J.48.71.G05.1.454.CMB.1.raw
tcagagtatacatacacgaccggtgctcgatttagtgtcgtcgcaagagagaggggggaagagctgctcagttaggacccagagggaaccataggaaaccccagcgcagcttctcttcctcctgctactctggctccagacaccaccggagaaattgtgttgacgcagtctccaggcaccctgtctttcgtctcgaaggggaaactccgcccaccctctccgtgtagggccaggtcaggaatgttaagacgccactctagcctggtaaccagacaaaaacctggaccacgtaccgtcccaaggtcctccctacgattacgtaagttcggtgccgttaccgaccgacgggtcccaacgtaggtcctactacccgaacgaacgtacgggttacgaaggtcggtaccgtaaggtcggggttcgtaacggggaacgaagtaccgttacacgttccactaacccgaataccgtaaccacgtaacgttcggacgtaccgtagaattcggtaagttttacgacgttagttttacgtttttacgtaccggttaacgtaaaggtaaacggttagtacggggtaaaacgttccgttaacccggtaaccgggtaacgtttaaccggtttacccgggaaccgggtaacgggggtaaaccccgtaaaaggggggtttaaccgaaaaaagttaaccggaaaaaccgtttacgttaccggggttaacggtacccgttaacgggtaaccctaaccggtaaaccgttttaccggtaacggtttaaccccgttttaccgtaaccgtttaccccggtttacccccggacctttaacccgg

SEQ ID NO: 107050 - DNA, 768 bp, Homo sapiens
  misc_feature: GYAE6OF02JH4LW.48.71.G05.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtctccaggcacctgtctttgtctcgagggaanccgccgaccctctcctggtaggccnggtcagagttgtaanacgccacttcctagccttggtaaccagaccaaaacctggcccaacgccctacccgaggtccttaccctacgtactacctagttcggtcggtccgtaccccgtacggacgggacccacggtcgggaccctaacgttacccccgaaggttacctaacggggtttacctaacgggttggaacccgtagggttccgggttacggtacgggaaccgtaacgttaccgttaccgacctttccgccgaaacctactacccgtaacgtacggtaccgtacgggtaccgtcccggtagtacggttttacggtaactttttacggacgttaaaccgtttttccgttttccgtaggttacgagttaccggttaaggtccgttaagggttaacttcccgtacttacccggtagttaccgttccggaaccgggtacggaccgtaaagggcgtaaacgttacgacggtagtccggtggtacgtacgtaaccgtcgtaacgttccgttgtccctttaagtcccgtttaccgtcccgtaaccg

SEQ ID NO: 107051 - DNA, 800 bp, Homo sapiens
  misc_feature: GYAE6OF02F9KRR.48.71.G05.1.454.CMB.1.raw
  modified_base (199)..(199): a, c, t, g, unknown or other
  misc_feature (199)..(199): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaattgtgttgacgcagtctccaggcaccctgtcttgtctcgagggaancgccaccctctcctggtaggccagtacagatagtaagacgcctactccttagccgtaggtaccagaccaaaaccgtcggccacgcctcccgagcctctacatctagtggtcgccgtaccgaccgaccgggccctacggtcggacctaccgtaccccgaacggtaaccgtacgggttaccgaggttcgggacgtacgggttcggggtaccgtagggaccgtaacgtttacccgttaccgtaaccttccctaacccgtaacccgttaacctaacccgtaacccgtaagtaccggtacgggtaacccgtaccggtagttacgtttagtttaacgtttcgtacgtttaacggtttttcgttttaccgttcgttaacgacggttacgttaaggttacggttaacggttaccgttcccgttaaccgtaccgggttaccttaccgggtaacccgggtacgggtaaaccggggttaaccgtaaacgggttaaacgtaaaccgttaaccggaaacgttacggttaccgggtacgtaccggtaaccgtaccctacgttacgtttccggtacgtttacccgttacctacccggtttacccctacccgttacg

SEQ ID NO: 107052 - DNA, 600 bp, Homo sapiens
  misc_feature: GYAE6OF02FH518.48.71.G05.1.454.CMB.1.raw
  modified_base (205)..(205): a, c, t, g, unknown or other
  misc_feature (205)..(205): n is a, c, g, or t
  modified_base (428)..(428): a, c, t, g, unknown or other
  misc_feature (428)..(428): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaaacncgccacctctcctgtagggccagtcagaactgttaagacgccactccttagcctggtaccagacaaaaccgtggccacgcctccaggctcctcactctagtggtgccgtccaccgagggccacgtcggcactcccgagacctacggttcacggtcggcgaggttgggtcgtgggacacggtacttcactacctcacctacgtccaaccgacgacgtacggacnccgtagatgtactttagcgttagtttgttttctgtcagtctagtagtacggtattcgacgtacggactagttcggcggaacgggaactagggtacgaactaccgaacgtagtcggtacgacttacgacctaccgtctacgttcttaccgttactacgttacccttccgtacc

SEQ ID NO: 107053 - DNA, 756 bp, Homo sapiens
  misc_feature: GYAE6OF02HRV8A.48.71.G05.1.454.CMB.1.raw
  modified_base (212)..(212): a, c, t, g, unknown or other
  misc_feature (212)..(212): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctacccagaccaccaccggagaaattgtgttgacgcagtctccgaggccaccctgttctttgtcctaccgaaggggaaancccgtccctacccctcgtcctggtacgggccaacgtcaaagtaattacggttaaacgacggtcccaacgttccttacggccgtacggtaacccagaaccaaaaaccgtcggcccacgccctccgaacggtcctccctactctacgttagtcggtcggtcgtaccccgaacgaccgggtccacgtcggactacctacccaggtaacgtacggtcgtacggtcggacgtaggttcgggtacgtacgggtactacggtacttaccgccgttacctctacccgaacttcgaacccaggtacctacgggcgtacccgtggtattacggttgttttcgacggttacgttttcggttttacgcgtaccgttacgacgttaacgttacggtacgggtaacctttccgaacccggtttacggttaccgttacggttacgggaccgggaacgggtaccgtaaagggtaacgtaaactaaccgaacgtgtacgggttcggcgttcgaacctaaccgtcgttaacgttcggttcctacttcttccccgcccgttac

SEQ ID NO: 107054 - DNA, 756 bp, Homo sapiens
  misc_feature: GYAE6OF02G3JCM.48.71.G05.1.454.CMB.1.raw
  modified_base (207)..(207): a, c, t, g, unknown or other
  misc_feature (207)..(207): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagaaattgtgttgacgcagtcctccaggccaccctgtctttgtctccgaggggaacnccgccaccctctccgtgtacgggccagtcagactgttaagcgccactccttagccgtaggtaccagaccgaaaaacctggaccacggccctacccgaacggcctccctacgacttctaagtgggtcgccgtcccgaaccgacggggtacccacggtacggaccaccgttccccgaaggacctagggtttccgacggttacggctaacgggttcgggtaccgtacgggaaccgacgttaccgttaccgtaccgtccgttaccaaccgtactaccgaacctacgtaccgtagggacctccgtaggtactacgttacgtttacggcgttaacggtttcgttttactcgttacgtacgtacgtagttaagtacggtacttaccgtacgtaccggtaacttcggttaccggaccggtacgggtaaccggtaggttaaacggtaaccgtaaccggaaaccgtacggttacggtacgggtaccgtacgtaaccgtaccgtagtttacccgtacggtttacccgttaaccgtacctttccccggtaccccgttaccg

SEQ ID NO: 107055 - DNA, 671 bp, Homo sapiens
  misc_feature: GYAE6OF02HAXTY.48.71.G05.1.454.CMB.1.raw
  modified_base (568)..(568): a, c, t, g, unknown or other
  misc_feature (568)..(568): n is a, c, g, or t
tcagagtatacatacacgaccggtgctcgatttagtgtcgtcgcaagagagagggggaagagctgctcagttaggacctagagggaaccatggaaaccccagcgcagcttctcttcctcctgctactctggctcccagacaccaccggagtaaattgtgttgacgcagtctccaggcaccctgtctttgtcctccgaggggtaaagcgccacccgtctccgtgtacgggccagtcagtaatgttaaacgacgcccacttccttagcccgttgtaccgaagaccaaaaccgtcgaccgacgtccctcccgaggtcctccgtacactcctagtggttcgccgtacccgaccgacggcccgacgtcggacaccgtacccgagaccgtacggttacgaacggtcggtacgtaggttgggtacgtagggacgtacggtacttccgtaactcgtacccacctactaccgaccgtaacggtacggtacggacctccgtaaggtacgttacgttatttcggacgttaggttttcgttttcgtacgttacgacgtcgtaagtacgtacggtacttcncgtacgacgtccgtacggacgacgggtacgaaggtacgaactacgagtacgtggtacggctagcctacgtacgttcgtcgttgttcctcttaccgtcccgtac

SEQ ID NO: 107056 - DNA, 561 bp, Homo sapiens
  misc_feature: GYAE6OF02G4HAF.48.71.G05.1.454.CMB.1.raw
  modified_base (203)..(203): a, c, t, g, unknown or other
  misc_feature (203)..(203): n is a, c, g, or t
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (482)..(482): a, c, t, g, unknown or other
  misc_feature (482)..(482): n is a, c, g, or t
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtcctccaggcaccctgtcttgtctccgagggaacncgccacccgtctctgtacggccagtcagtaatgttaagacgcctactccttagccgtggtaccagacaaaaaccgtgaccagaccctccaaggcctcctcgatcgtagtcggtcgccgtaccaccggacggccagtcgcactccagactgtcagngcgagtggtcgaggacagtactcnctcgtcactancactagacctggactcngtactagtattgacgtgtttctttcagtctacgtctagttactgggtaacctctacgcgtaactcgtaccgnggaacgaacgagagtaaacgactagtaactggtcgtaacnctcgtaacnttccgacttcgaacctactcccgtccgtac

SEQ ID NO: 107057 - DNA, 619 bp, Homo sapiens
  misc_feature: GYAE6OF02G1IPJ.48.71.G05.1.454.CMB.1.raw
  modified_base (321)..(321): a, c, t, g, unknown or other
  misc_feature (321)..(321): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
tcagagtatacatacacgaccggtgctcgatttagtgtcgtcgcaagagagagggggggaagagctgctcagttaggacccagagggaaccatggaaaccccagcgcagcttctcttcctcctgctactctggctcccagacaccaccggagaaattgtgttgacgcagtctccaggcaccctgtctttgtctccgaggggaagcgcccaccctctcctgtagggccagtcagaatgtaagagccactccttagcctgtaccagacaaaactgccacgcctccagctcctcatctatggtgccgtccaccgacggccacgnggcactaccagactaggttacagtggctaggtggtcgtgggacagtactcactcgtcaccanccaccagacgtaggacnctagtatacgttatttcgacttagttttcgttttactcggtacgtacgtacgtagttagtacggtaacgttaccgtaccgttacggactacggttaccggtaccggaacgggggtaacctaaagggtaacgaaaacttacggaaacgtacgttagggtacggacctaggaccctaccgtacttccgttagttaccttacgtacctttcccgtacccgac

SEQ ID NO: 107058 - DNA, 804 bp, Homo sapiens
  misc_feature: GYAE6OF02H6NC4.48.71.G05.1.454.CMB.1.raw
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
  modified_base (757)..(757): a, c, t, g, unknown or other
  misc_feature (757)..(757): n is a, c, g, or t
tcagagtatacatacacgaccggtgctcgatttagtgtcgtcgcaagagagagggggaagagctgctcagttaggacccagagggaaccatacggaaaccccagcgcagcttctcttcctcctgctactctggctccagacaccacggataatgtgtgacgcagtctcgagccncctgttcttgtcncggaagggaagccnccgtacctctccgtggacggcctagtcagtaagttagtaagcgtcctacgtcgttacgccgtacgtaaccagaaaccaaaaccgtcgaccaagtccctaccgaggtcctccgtacacgtcgttaagtaccggtaccgcccgtaaccgaccggacctaccgtcggacctaaccgtcccgaagtaccgttaggttacgacggtcggtacgtagggttcggtaccgggtaggtaaccgtacggtacttccgtaccgtacctcgtaacctacgtaaccgacccgtaaaggtccggtaacggtcccgtaccgtttaaggaacggtttccgttaacggttttacgtaccggttttaacggttttcggttttttacgcgtttaaggaccgggttagtaacggtttagggttaaccgttaacgttcccgttaaacggttacgtaaccggttcggttaaccggccgggttaaacggaccggttaaagggtaacgtaaaacctaaccgggtaacgtacggtaccggttggtaacccgtagacccgttaactacggtttcccggttnttttaacccggccgtttaaccccgtctttaccccgggtattaacccg

SEQ ID NO: 107059 - DNA, 753 bp, Homo sapiens
  misc_feature: GYAE6OF02HPMJ3.48.71.G05.1.454.CMB.1.raw
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggcaccctgtctttgctccgaggggaaacgccgccaccctctccgtcggtacgggcctagtccaagaattcggttaagagtaccactccttacgcctcggtaccagaccaaaaaccgtcggaccacgcctaccgagacctcctacgtactactacgtcggtcgtccgttccaaccgacggggaccctacgtacgcactcccgaagaccgtaggttcgaggtcggtcgtacggtgggtctacgggacacgtacgttcaccgttctaccgaccgtaacgtccgtaacgacggtacgtggaccgtacctagtactgttacgttttcgacgtacggttttagttttacgtcggttacgacgttaggtacgttaacggtacggtacgtttaccgaacccggtttacggaaccggttacgttaccccgggacggggttaacccggggtaacgggtaaacggttaacgtaaaccgtaccggttaaaccggaccggtttacgggccggttacgaccgtacccggtaacttaccggttccgtttaccggttaccctttaaccggtaccgtttcccgttaccccgtacg

SEQ ID NO: 107060 - DNA, 700 bp, Homo sapiens
  misc_feature: GYAE6OF02FUIF1.48.71.G05.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctgctcccagaccaccaccgganaaattgtgttgacgcagtctccaggtcaccctgtcttgtctcgagggtaanccnccacctctcctgtacggcctagtcagtatagtaacgacncctacttaccgttagccttaggaaccagaaccaaaaacctgaccgactccgtacccaggcctccgctatcgtagtcgtcgaccgtaccgaaccgaggcctacgtggacctacncccagtaccgaggtaccgtaggtcggctaggtgggtaccgtcggacgtagaccctctaacgtcgtacacctctaccctacgacgtaactcgggtaccgcgttacgacgttaggttacttttacgcttaggtttcgttttccgttacggtactacgttacttacgtagttacgtaccgttaccgaccgttacgtaccgtacgtacccggcggtaaccgggtacgtaacggtaagtaaacgacgttaaacggacgtttcgggtacgaccggttacggtaccccttaacgtagttacccgttcggtttaccctacccgtacggttttaccccctaccgttaacccg

SEQ ID NO: 107061 - DNA, 674 bp, Homo sapiens
  misc_feature: GYAE6OF02IBVDD.48.71.G05.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctcaggcaccctgtcttgtctcgagggaancgccacccgtntcctgacggccagtcagtaatgtaacgcgccactcttagcctggtaccagacaaaacctcggccagcctaccaggcctcctcactctagtggtcgtccgccaccgtcggaccctcgtcgcacgtacccgagacgtaggttcgacggtgcgtaggttgggtcggtaggacgtacgtacttaccaccgtcctaccgaacctacgtaccgaacctacgtcgtaggacgtccgtagtacgtttacgttagtttcgtacttacgggttttcgtttttacgtcggttactaggttaccgtaagttaacgtggttaaccgttccgtaaccgtccggtaacgtacggttaccggaccgggtaaaccgggaaccgtaaacggggtagtaaacgttacccgaaacggtaccgttagggtcctcggtacaccgtacgtcgttacgtcgttacttacgcctttacccggctacccg

SEQ ID NO: 107062 - DNA, 786 bp, Homo sapiens
  misc_feature: GYAE6OF02IH3BI.48.71.G05.1.454.CMB.1.raw
tcagagtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagtaaattgtgttgacgcagtctccaggcaccctgtctttgtctcgagggaaagccgcccacctctcctggtacgggccagtcagaatgttaaagacgccactcttagctggtaccagaactaaaaaccgtgaccacgccctaccgacggtacctcctctactctagtaggtcgtcctaccgaccgacggccacgtacgctacctaccgacgaccgtaggttacgaaggttcggacgtaggttcgggtcgtcgggaacgtagtaccttcgtaaccgttcctaacgaacctacgtacccaaccgacgtaacgtacgggacgtacccgtgtaaactcggtttaagttttcggacgtttaggtttttcgttttttaccgttaggttacccgtaaggttaccgttaagggtttaacggtaacggtttaaccgttccggtaaccggtttaccggttaacgttcggttaacccgggtaccgggtaaaccgggggtaaccgttaaacggggtaaccgtaaaccggttaaaccgtaaaccgggtacggttacgggtaacggtacccgttaaccgtaaccgtaacccgttacgtttaccgttaccgtttaccgttaaccgtaacccggtttccccttacccgtaccg

SEQ ID NO: 107063 - DNA, 753 bp, Homo sapiens
  misc_feature: GYAE6OF02H6IFS.48.71.G05.1.454.CMB.1.raw
  modified_base (206)..(206): a, c, t, g, unknown or other
  misc_feature (206)..(206): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacacccaccggagaaattgtgttgacgcagtctccaggccaccctgttctttgtctccgaggggaanccgacctaccctctccgtggtacgggccagtcagaattgttaagcgcctactcttagccgtaggtaccaagacaaaaaccgtcggaccacgcccctacccgacggcctccctcactctagtggtcgccgtccaccgacggccacgtcggccactccgaacgccgtacggttacgaggtacggacgtggtcgggttcgagggaacgacgtacctacgtaccgtcctaaccgacctactaccgaaccctaacggtaccgtacgggtaccgttccgttaacggtacgtttacggttaacttttcggtaccgttacgggtttttcgtttttttaccgtgttaccgtaacggttacgttaacggttacgttaagggtaaccgtttaccgtaccgttaacccgggtagttaccggttacgggaccgggtaacgggtaaccggtaagggtaaccggtaaactaaccggaaaccggtaggttccggcggttacctcgggtaaccctaccgtagttccttacggtttcccttacgtacccgtttccgtcccctacg

SEQ ID NO: 107064 - DNA, 666 bp, Homo sapiens
  misc_feature: GYAE6OF02HLKZ6.48.71.G05.1.454.CMB.1.raw
  modified_base (169)..(169): a, c, t, g, unknown or other
  misc_feature (169)..(169): n is a, c, g, or t
  modified_base (207)..(207): a, c, t, g, unknown or other
  misc_feature (207)..(207): n is a, c, g, or t
  modified_base (315)..(315): a, c, t, g, unknown or other
  misc_feature (315)..(315): n is a, c, g, or t
  modified_base (447)..(447): a, c, t, g, unknown or other
  misc_feature (447)..(447): n is a, c, g, or t
  modified_base (552)..(552): a, c, t, g, unknown or other
  misc_feature (552)..(552): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagaccaccaccggagtaaattggtgttgacgnagtctccaggccacctgtctttgtcaccgaggggaacnccgccacctctcgtgcggcagtcagtattgttaaagcacctacttcttacgccgttcggaaccagaaccaaaaccgtcgaccgtacgccgtacccgacgtcctcccanactcttagtcggtcgccgtccaccggaggcccacgtcggctaaccgtccgagaacgtcggttacgtacggtcgtccgtaggtcgggtcgtacgggacgtacgttaacgtcctaacgtcctacgaccctaacnccgtaacgaacgacgacggtacgtaaccttggaacttgtagttttcgcgtttacggttttcggttttactgttacgacgttcgttagtacgttacgtacgttacnccgtaacgtatacgtcgacggtaaggaaccgtagtaacgtaactacgaaagtcgtaggcgtacgttagaccgtacgtacttcgtaccgtcgtaaccttcgtacccgtctaaccg

SEQ ID NO: 107065 - DNA, 718 bp, Homo sapiens
  misc_feature: GYAE6OF02JWDMV.48.71.G05.1.454.CMB.1.raw
  modified_base (202)..(202): a, c, t, g, unknown or other
  misc_feature (202)..(202): n is a, c, g, or t
  modified_base (544)..(544): a, c, t, g, unknown or other
  misc_feature (544)..(544): n is a, c, g, or t
tcagagtatacatacacgaccggtgctcgatttagtgtcgtcgcaagagagaggggggaagagctgctcagttaggacccagagggaaccatggaaaccccagcgcagcttctcttcctcctgctactctggctcccagacaccaccggagaaattgtgttgacgcagtctccaggccaccctgtctttgtctcgagggaanccgccacctctcctgtacggccagtcagtattgttaagacgcctacttccgttacgccgtcggtaacccagaacctaaaaacccgtcggacccgtacgtacccctaccgacggtcctaccctctacttctacgtcggtcgtccgtacccaccggaccggtccgtacgtcggacctaccgtacccgagtaccgtacgggttacgacggtcggtacgtacggttaggtccgtagggacctacggtacgttcacgttaccgtacctaccctaactacccgacgtacgacgtacggacgtcgttagtacgttgttacgtttggtacgttacgttttcgttttacgngttcgacgttcgtaagttacgttaggtaaccgtttccgacgtacggtcgttaccggtcggaccgtaccgggtaacgtaggtaacgtaacgtaaccgacggtactcgggtacgtacgttaccgaccgtactacgttccttacgtaccgtttacgtaccgttaccgtccccgtaac

SEQ ID NO: 107066 - DNA, 154 bp, Homo sapiens
  misc_feature: GYAE6OF01D5OG8.23.86.H09.1.454.CMB.1.raw
  modified_base (154)..(154): a, c, t, g, unknown or other
  misc_feature (154)..(154): n is a, c, g, or t
tcagacgcgagtatcacgaccggtgctcgatttagtgctatagacttgggtttgggaccaagctggagatcaagcgaactgtggctgcaccatctgtcttcatcttcccgccatctgaatactcgcgtctgagcgggctggcaaggcgcatagn

SEQ ID NO: 107067 - DNA, 531 bp, Homo sapiens
  misc_feature: GYAE6OF01A2A9F.23.86.H09.1.454.CMB.1.raw
  modified_base (519)..(519): a, c, t, g, unknown or other
  misc_feature (519)..(519): n is a, c, g, or t
tcagacgcgagtatcacgaccggtgctcgatttagtgctatagacttgtgtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctccaggctcctcatctttgatgcctccaataggtccctggctcccagccaggttcagtggcagtgggtctgggacaggacttcactctcaccatcagcagcctggagcctagaagtattttggtgttttattactgtcagtaaccgttgactaacgttggtactacgttttgggacctagggggtacccaaggtctagggagatcgaagcgaacgtggtcggctgcacatctgttcttacntccttcccgacc

SEQ ID NO: 107068 - DNA, 601 bp, Homo sapiens
  misc_feature: GYAE6OF01D3VRW.23.86.H09.1.454.CMB.1.raw
  modified_base (407)..(407): a, c, t, g, unknown or other
  misc_feature (407)..(407): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagagccaccctctcctgcagggccagtcagagtataacactgcgcagcctggtgaccaaacaaaaacctggaccaggcctcccgaggcctcctcattctttgatcgccctaccaagtacggggtccctggccgtcccagccgtaggttcaggtggcaggtgggtctgggacagacttcactctcacatcagcacgtccgtggacnccgtaggtaaagttgttttggttagtttaattactggtactaacggtaaccgtttgacctaacgttcggttaacctacggttttcgggacccgtaagggggaaccctaaggtcgtaggagtacgtacgaacggtcgaaacgtggtacggctagaccacctattcgtgttccttctacttcccttccccgctacg

SEQ ID NO: 107069 - DNA, 599 bp, Homo sapiens
  misc_feature: GYAE6OF01ELV8K.23.86.H09.1.454.CMB.1.raw
  modified_base (407)..(407): a, c, t, g, unknown or other
  misc_feature (407)..(407): n is a, c, g, or t
tcagacgcgagtatcacgaccggtgctcgatttagtgctatagacttggggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaacctggccaggctccaggctcctcatctttgatgcctccaatacgggtccctggcctcccagccaggttcagtggcaggtgggtctgggacagacttcactctcaccatcagcagccgtggacgcctgaagtattttggtnttttattactgtcagtaaccgttgactaacgttggtactacgttttgggaccctaggggaccctaaggtcttagggaacgacgttacgaaacggtaccggtaaacgtgggttacgggccgttaggaccctaaacccgtaattccgttcgtttacctttacctaactttcccgtttcccccggcccttaaacg

SEQ ID NO: 107070 - DNA, 573 bp, Homo sapiens
  misc_feature: GYAE6OF01BOS3J.23.86.H09.1.454.CMB.1.raw
  modified_base (418)..(418): a, c, t, g, unknown or other
  misc_feature (418)..(418): n is a, c, g, or t
tcagacgcgagtatcacgaccggtgctcgatttagtgctatagacttgggtttgggggagggaactgctcagtcaggacccagagggaaccatggaagccccagctcagcttctcttcctcctgctactctggctcccagataccaccggagaaattgtgttgacacagtctccagccaccctgtctttgtctccaggggacagagcccaccctctcctgcagggccagtcagagtattaacaactgcgcagcctggtgaccaacaaaacctggccaggctccaggctcctcatctttgatgcctccaagtacgggtccctggcgtcccagcctaggttcagtggcaggtgggtctgggacagacttcactctcaccatcacgcagtccctggacgcctaggtaagttattttgggtntttaagtttactgtctagtaccgtttgactaacgtgtactacgttttcggaccgtaggggaaccaagtccgtaggagtatacgaagcgtaaacgtggtgtcgtacgacctaccgattccgttacgttccttctaacttcccgttcccgtccgtac

SEQ ID NO: 107071 - DNA, 904 bp, Homo sapiens
  misc_feature: GYAE6OF01C23X0.23.86.H09.1.454.CMB.1.raw
  modified_base (248)..(248): a, c, t, g, unknown or other
  misc_feature (248)..(248): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgctccaggggacagacgccaccctctcctgcagggccagtcagagtattaacaactgcncagcctggtacgacccaaaacaaaaaaccgtcgggaccaacgggcctaccccgaagggcccttaccctactaacttcctttttacggaacttaccggtaccccttacccgtaaaaggtttacccgggggttcccccgttaggggtccccgttacccccgaaacgggtcccccgtaacggggttttacccgaagggtttcgggaccggttaagggtttccggggggttacccgttagggggggaacctaagggtaacccgttttacccgaacccttccccgttaccaaacccctaattacccgaaacggccaacggtcccgttagggacgtaccccgtttaggtaaaacggttagtttttttcgggtttaagtttttaacgtttaaccgttacggttaccgtaaaccggttaaacccggtttaggaacccgtttaaacggttacgggtttaacctttaaccgggtttttttaccgggggaaccccggttaaaccggggggaaaccctaaacggggtccgttaacgggtaaacggtcgttaaaccgaaacggtacccggtaaacgttgggtacgggtaccgtagtacccgtaacccgtaattcccgtttacggtttacctttactacccgttttcccgttaccccgtaccgttaaccg

SEQ ID NO: 107072 - DNA, 857 bp, Homo sapiens
  misc_feature: GYAE6OF01DUKK3.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtcctccagcccaccctgtctttgtctccgaggggacagacgcccaccctcctcctgccgagggccagtcaaggtagttaacttaaacaacgtgccgcacgtccgtggtacgaaccctaaaaccaaaaacccgtcggaccctaacggcctacccgaggtccctcctactacttcgtttagacgttccgtacccgtaaccgtaacggtccgggtcccgtcgggtacccgttacccgacggtcccgtaggttccgaggttggccgtaggttcggggtacgtcggggaactacggtacctacctacgtccctaccaaccgtataccgaacggtcccgtaacggtcccgtacgggaaccggtacccgttaaggtaacggttttaaaggttttttcggggtttaacgtttttaacgttaacggtttcgggttaacccgttaaacgggttaacccggtttacggtaaccgttaaaccggtttagggtttaacccgtttacgggttttaaccgggaacccgggtaacgggggtaaaccctagggttaaccggtcgggtaacgaaccgttaacgggaaaccggtaccggttaacggtagggttcccggtacttaccggaaaccctaacccgttccgttaccgttacgtttaccctttacccgtaaccttttcccccgttccccggtaaccttaaccgg

SEQ ID NO: 107073 - DNA, 552 bp, Homo sapiens
  misc_feature: GYAE6OF01CNCUD.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtataacaactgcgcagcctggtgaccaaacaaaaacctggccaggctcccaggctcctcatctttgatgcctcaatcgggtccctggccgtcccagccaggttcaggtggcaggtgggtcgtgggacagacttcactctcaccatcagcagcctggacgccgtagaagtattttggtatttattactgtcgaagtaaccgttgactaacgtggtaacctacgttttcgggaccgtaggggacccaaggcgtggaagatacgaagtcgaactggtcggctgacacctagtcttgtccttacattcccttccccgtctacg

SEQ ID NO: 107074 - DNA, 576 bp, Homo sapiens
  misc_feature: GYAE6OF01AIYYR.23.86.H09.1.454.CMB.1.raw
  modified_base (370)..(370): a, c, t, g, unknown or other
  misc_feature (370)..(370): n is a, c, g, or t
  modified_base (561)..(561): a, c, t, g, unknown or other
  misc_feature (561)..(561): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgaccaacaaaaacctggccaggcctcccaggctcctcatctttgatgcctccaatagggtccctggcgtcccagccaggttcagtggcagtgggtctgggacagacttcactcncacatcagcagccctggacgccgtagaacgttatttttcgggtgttttaactttacttgttacctaacgtaacccggtttgacctaaacgttcgggttaaccttacgtttttcgggacccgtaacgggggaccctaaaggtcgttagggagactacgaagcgaaactgtaggctagccacatctgtccttnatcccttcccgctac

SEQ ID NO: 107075 - DNA, 582 bp, Homo sapiens
  misc_feature: GYAE6OF01CHLDG.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggaccaggctcccaggctcctcatctttgatgcctccaatacgggtccctggccgtcccagccaggttcagtggcagtgggtctgggacagtcttcactctcaccatcacgcacgtccgtggactcccgtagtaacgttagtttttggtagttttattacgtgtactaggtaaccgttgactaacgttgtactacgttttcggaccgtacgggtaaccaggtacgtggaagtacgtacgaagccgtaaactgggtacggtcgtagcgtacctattcgtgttcccttacgtacttcccgttccccgccttacg

SEQ ID NO: 107076 - DNA, 640 bp, Homo sapiens
  misc_feature: GYAE6OF01A6JUX.23.86.H09.1.454.CMB.1.raw
  modified_base (257)..(257): a, c, t, g, unknown or other
  misc_feature (257)..(257): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtnccaaacaaaaacctggaccaggctccaggctcctcatctttgatgcctaccaatacgggtccctggcctcccagccaggttcaggtggctaggtgggtctgggacagacttcactctcacatcagcacgcctggacgcctagaagtattttggtatttaattctgtacagtaccgttgacgtaacttggtaacctacgttttcgggacccgtaagggggaaccctaaagggtccgttagggaacgtacgtacgtaaacggtaccggtaaacgttcgggtacggtacccgttaggacccgtaaacccgtaagtttcccgtttacgttaccccgttttacctaacccgttttacccccgtttaccccccggtacctttaaaccgg

SEQ ID NO: 107077 - DNA, 624 bp, Homo sapiens
  misc_feature: GYAE6OF01EG7GU.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgcccaccctctcctgcagggccagtcagagtaattaacaactgcgcagtcctggtcgaccaaacaaaaccgtggaccaggcctacccgaggcctccgtctagttctttgattcgcctaccaagtccgggtccctgggcccgtccacgcctaggttcgaggttcggcgtaggtcggggtcgtaggggtacagtaccttcgactccgtaccacctatccagcgtacgccgtagggactccgttagtaacgttgttttggtatttacttcgtgtaccgtaagtaccggttgacgtaacgttgtacctacggtttcggaccgtagggtacctaaggtcgtaggagtacgtacgaaggcgtaacgtggtacggccttgaccctacgtatccttagttcccttactattcccgttcccgcgtta

SEQ ID NO: 107078 - DNA, 608 bp, Homo sapiens
  misc_feature: GYAE6OF01CHJK2.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtcgccaaacaaaaaaccctggaccaggcctcccgaggcctcctcatctttgatgccctcaagtacgggtccctggccgtcccagccaggttcaggtggcaggtggtctgggacagacttcactcctcaccatcagcacgcctggacgcctagaagtgttttggttgtttattactgtcgtaagtaaccgtttgacctaacgttggtaaccttacgttttcggaccggtaggggaacctaaggccgtagggagtagtaccgaagacggaaacttgggtcggtccttggaccctaaccgtaagttccgtttacggttcctttaccctatttaccccgttccccgcccgtttaacg

SEQ ID NO: 107079 - DNA, 648 bp, Homo sapiens
  misc_feature: GYAE6OF01D7UCT.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatcgcctccaagtacgggtccctgggccgtcccagccaggttcagtggcaggtgggtctgggacagcttcactctacaccatcagacacgccgtgggacgtccgtaggtaaagttagtttttagggttagttttaatttacgttacggtttacaaccggttaacccggtttcggaaccttaaaccgtttagggttaaaccttcggtttttacgggacccggtaacgggggtaaccctaaagggtccgttaggggtaacgtacgtacgtaaaggaccgtaaacgtggttacggctacggactacctacgttcgttcggttcctttactacgttcccttccccgccttaacg

SEQ ID NO: 107080 - DNA, 615 bp, Homo sapiens
  misc_feature: GYAE6OF01A41XT.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgaccaaacaaaaacctggccaggcctcccaggctcctcattctttgactcgcctaccaagtacgggtccctgggccgtcccgagcccgtaggttccaggtcggctaggtgggtctgggacagtacttcgactctcaccatcagccagcctggacgtccgtagtaagttagttttggtagttttagttacgtgttacgtaacggtaaccgttgactaacgttggtaaccttacgttttcggaccgtaggggacctaaggtcgttagggagtacgtacgaaggtcgtaacgtggtcggtctcggacctaccgtagttcccgttcgttaccctttactacctttcccgttccccgtcctacg

SEQ ID NO: 107081 - DNA, 788 bp, Homo sapiens
  misc_feature: GYAE6OF01BMN4E.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgacgcagcctggtcgaccaaacaaaaaccgtggaccaaggcctcccgaggcctcctcatcctttgatcgcctaccaagttacgggtccctggccgtcccagccaggttccaggtcggcgtaggtgggtcgtaggggacacgtacttcgactcctacaaccctatccgaacgtccaacggcccgttacgggacgtacccgttaggtaaaggtttaacgttttttaggggttacgtttttaacgttaaccgtttacggttacccgtaaacggttaaccccggttttaagacccgttaaaaccggttttgggtttaaaccccgtttaaccggttttttaccggggaaccccgggttaaacggggggtaacccccgtaaagggttacccggttaacggggtaaacggtaaccgttaaccggaaaacgggtacccggtaaaaccggttcggttaccgggtcttacggaaccccgtaaccgttaacgtttccggttaacgtttccctttacccgtaacctttccccgtttacccccggtactttaacccg

SEQ ID NO: 107082 - DNA, 713 bp, Homo sapiens
  misc_feature: GYAE6OF01DR8X4.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtcctccagcccaccctgtctttgtctccgaggggacagacgccaccctctcctgcgagggccagtcagagtaattaacaactgcgcagtccgtggtcacccaaacaaaaacccgtcggacccaacggcctacccgaggcctcctctacttctttgactcgccctacgtaagtaccgggtccctcggccgtacccacgccgtaggttcgaggtcgcgtaggtcggggtcgtacggacacggtaccttcgaccttcctaccgacctacgtcgacggtacgtacggtacggttaacgacggtaccgttaaggtaaagtttgttttacgaaccgttttagttttacgtttaaccttgttaccgtaccgtaccgtaaccggtacgtaacccgttaaccgtcccggtacccgttaccggtttcccgggcccggttacgggacctaacggtaccgtacgtaaccgtaacgttaccgaaaccggtacgttcggtcggtactacggacctacctagttcccttcgttaccttaccgtacctcccgttccccgac

SEQ ID NO: 107083 - DNA, 634 bp, Homo sapiens
  misc_feature: GYAE6OF01DZFGB.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgctccgaggggacagacgccaccctctcctgcagggccagtcagagtattaacactgcgcagcctggtcgaccaaacaaaaacctggaccaggcctccaggcctcctcattctttgactcgccctccaagttacgggtccctgggcctccccgagcctaggttccaggtcggcgaggtgggtctgggacagtacttcactcacaccatcagcagccgtggacgcctagtaacgttagtttttggttagttttaattacgttgttacgtaacgtaaccgtttgactaacgtcggttaccttacgttttcggccgtaacggggaacctaaggcgttaggacgtacgtacgaaacgtccgtaaacggttggtacgggtacctggaccctaaccctacgtttccgttacggttcctttaccgtactttcccccgttccccgccttaaccg

SEQ ID NO: 107084 - DNA, 610 bp, Homo sapiens
  misc_feature: GYAE6OF01BW4US.23.86.H09.1.454.CMB.1.raw
  modified_base (406)..(406): a, c, t, g, unknown or other
  misc_feature (406)..(406): n is a, c, g, or t
  modified_base (428)..(428): a, c, t, g, unknown or other
  misc_feature (428)..(428): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagacgccaccctctcctgcagggccagtcagagtattaacaactgcgcagcctggtgaccaaacaaaaacctggaccaggcctacccgaggcctcctcatctttgatcgcctaccaacgtacgggtccctggcctcccagcctaggtcaggtggcaggtgggtctgggacagtacttcactctacaccatcagcagccgtggacnccgtagaacgttagttttggtntttaattacgtgtactaggtaaccgttgacctaacgttggtacctacgttttcggaccgtaggggacctaaggcgtagggacgtacgtacgaaggtccgtaacgtgggtacggtcctaggaccctaccgtacgttccgtacggtttcccttacgtaacctttcccttccccgtccttaaccg

SEQ ID NO: 107085 - DNA, 654 bp, Homo sapiens
  misc_feature: GYAE6OF01ECRTL.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagacgccaccctctcctgcagggccagtcagagtattaacactgcgcagcctggtcgaccaaacaaaaacctggaccaggcctcccaggcctcctcattctttgactcgcctaccgaagtacgggtcccgtcggccgtcccacgccaggttcaggtcggacgtaggtgggtcgtgggacacgtacttcactctacacctatcagcacgtccgtggacgacctagtaagttagttttggtagttttaacgttactcggtacctaacgtaaacccggttcgaccgtaacgttcggttaaccttacggttttcgggaccggtaagggggaccctaagggtccgtagggaacgtacgtacgtaaacggtccggtaaaccgtgggtcggcgttcgaccctaaccgtacttccgttaccggttacctttaccgaccgtttccctttccccgaccttacg

SEQ ID NO: 107086 - DNA, 604 bp, Homo sapiens
  misc_feature: GYAE6OF01B538Y.23.86.H09.1.454.CMB.1.raw
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgtctccaggggacagagcccaccctctcctgcagggccagtcagagtataacaactgcgcagcctggtgccaaacaaaaacctggccaggctcccaggctcctcatctttgatgcctccaatacgggtccctggccgtcccagccaggttcagtggcagtgggtctgggacagacttcactctcaccatcagcagcctgggacncctaggaagttattttgggtnttttagttacttgtctaagtaccgttgcgtaaaccttgggtaacctacgtttttcgggaccgagggggaaccctaaggtcgtagggtaacgtattaccggaaagtccggaaacttggtacgggcttagggaccctaacccgtattcccgttgttaccctttactacgttccctttcccccgtccttaacg

SEQ ID NO: 107087 - DNA, 644 bp, Homo sapiens
  misc_feature: GYAE6OF01EBX76.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgtctccaggggacagacgcccaccctctcctgcgagggccagtcagagtattaacactgcgcagccgtggtcgaccaaacaaaaacctggaccaggcctccgagctcctcattctttgactcgcctaccaagtacggtccctggcctcccgacgtccgtaggtcaggtcgcgtagtgggtcgtgggacagtacttcgactctacaccgatccagcagtccgtaggacaccgtagtaagttgtttaggttagtttacttacgttacgtactaacgttaaccgtttcgactaacgttgttacctacgtttacggaccgtaacgggacctaaggtcgtagggagtacgtacgaaacggtaccgttaacggtggtacgggtccgttaggacccgtaccctacgttccgttacgtttaccttacctaacccgtttcccgttacccccgtccttaacccgg

SEQ ID NO: 107088 - DNA, 639 bp, Homo sapiens
  misc_feature: GYAE6OF01C2R3F.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgtctccaggggacagagccaccctctcctgcacgggccagtcagagtataacaactgcgcagcctggtagacccaaaacaaaaacccgtggacccaaggcctcccgaggcctcctctatctttgatcgccctaccaagtacgggtccctggccgtcccagccaggtcagtgcaggtggtcgtgggacagtacttcactctacaccatcagcagcccgtaggacgtcctagaaacgttgtttttggtattttaacttcgtgtactaacggtaaccgttgactaacgttcggtaacttacgttttacgggacccgtaagggggacctaaggtcgtagggactacgtacgaaaggtccgtaaacgttgggtacgggccttaggaccctaaaccgtacgttccgttacggtttccctttaccgtactttcccccgttccccgtccgttaaaccg

SEQ ID NO: 107089 - DNA, 663 bp, Homo sapiens
  misc_feature: GYAE6OF01BVJU9.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgtctccgaggggacagacgcccaccctctcctgcagggccagtcagagtattaacaactgcgcagcctggtgacccaaacaaaaccgtggaccaggcctcccgaggcctcctcattcctttgactcgccctccaagtacgggtccctggcccgtcccagcctaggttcagtcggcgtaggtgggtcgtgggacagtacttcactctccacctatcgagtccgacgtccgtggacgtccgtaggtaaggttacgtttttgggttagttttaacttacgttcggttaccgtaacggtaacccgtttagaccgttaacgtttagggttaaccttacggttttaccgggaccgttaacggggaccctaaaggtccggttaggagtactacgaaaggtcgtaaacgttggtcggtccgtgaccctaccgtattccgttacgtttacttacctaccgtttaccctccccggtcttaaccg

SEQ ID NO: 107090 - DNA, 630 bp, Homo sapiens
  misc_feature: GYAE6OF01CKX0H.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgtctccaggggacagagccaccctctcctgcagggccagtcagagtaattaacaactgcgcagcctggtgacccaaacaaaaaccgtggaccaggcctcccaggcctcctcatctttgatgcctccgaatcgggtccctggccgtcccagccaggttcaggtcggcagtgggtctgggacagctcactctcacatcagcagcctggacgtcctagaacgtagttttggtagtttaacttacgtgtacgtaaggttaaccgttgacctaacgttcggttaacctacgttttcgggacccgtagggggacctaaggtccgtaggaacgtacgtacgaaacggtccggtaaacgttgggtacggtaccttaggacccgttaacccgtagtttcccgttacggttccctttacgtacctttccccgtttcccccgacttaacccg

SEQ ID NO: 107091 - DNA, 616 bp, Homo sapiens
  misc_feature: GYAE6OF01BP4NB.23.86.H09.1.454.CMB.1.raw
  modified_base (359)..(359): a, c, t, g, unknown or other
  misc_feature (359)..(359): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccaccctctcctgcagggccagtcagagtattaacaactgcgcagcctggtgaccaaacaaaaacctggccaggcctccgaggctcctcatctttgatcgcctcaagtacggtccctggcctccagcctaggttcaggtggcaggtgggtcnggggacacggacttcactcctacaccatccagcagtccgtggacgtcctagtaacgttagttttaggttcgtttaattaccgttgtacgtaggtaacccgtttgacctaacgttcggtaacttacggttttcggaccggtaacggggtacctaagggtccgtagggagtacgtacgaaggtacgtaacgttgggtcggtaccgtagacctaccctattccgttacgttccttactacccttccgttccccgctaacg

SEQ ID NO: 107092 - DNA, 553 bp, Homo sapiens
  misc_feature: GYAE6OF01BDN15.23.86.H09.1.454.CMB.1.raw
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
  modified_base (546)..(546): a, c, t, g, unknown or other
  misc_feature (546)..(546): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatacgggtccctggccgtcccagccaggttcagtggcagtgggtctgggacaggacttcactctcaccatcaacncgcctggcgcctgaagtntttggtagtttattacgtgtctagtaccgttgactacgtggtactacgtttggccgaaggggtaccaaggtcgtgggagattacgaagtcgtaacgtgtacgggactcgacacctagtcctgttccttcacttcccttccccgtcncgttacg

SEQ ID NO: 107093 - DNA, 800 bp, Homo sapiens
  misc_feature: GYAE6OF01DA13B.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaaccggagaaattgtgttgacacagtctccagccacctgtctttcgtctaccgagggacacgacgcctaccctctcctgcgagggccagtcagtatattaaccactgcgcacgccgtggtcaccaaacctaaaaccgtcggaccgacggtcctacccgacggtccttcccgtactactttccgtttagaccttccggtaccctaaccgtaacggggtttcccggtcccgtcggggtacccctacccgaccggtaccgggtttaccggttacgtacgggtccggtacgggtacggttacgggggttaccgtaggggtaacccttaacgttacccgtttaccctaccgttacccgttaaccacccgtaacgtaccgacggaccgtaccggtccggtacgggtaacgtaccgtaaggttttaacggtttacgtttttacggttacgttttacgtaaccgtaggttaaccgtaacggtaccgttacgtaaccgttacgtttacgttccgttacggttacggaaccggtacgggactacggtacgtacgaacggtactacggaacgtccgtacggtacggttccggactaccgtaaccctaccgttcgttccgtttacgttcccttacttaaccccggttccctacccgtcttaaaccgg

SEQ ID NO: 107094 - DNA, 896 bp, Homo sapiens
  misc_feature: GYAE6OF01D93O2.23.86.H09.1.454.CMB.1.raw
tcagacgcgagtatcacgaccggtgctcgatttagtgctatagacttggggtttgggggaggaactgctcagtcaggacccagagggaaccatggaagccccagctcagcttctcttcctcctgctactctggcctcccagactaccaccggagtaaattgtgttgacacagtctccagcccacccttgttctttgtctcgaggggacagacgcccaccctcctcctgacgacggccagtcgagtaagtaacttaaaccaacgtcggccgacgaacggtccgttacggtaccgaaacccaaaaacctaaaaacccggtcgggaacccgacgggtcccgtacccgacggtccccttaccgtacctacgtttccgtttacgaccgttccgtacccgttaaccgtaaaccggtttaccgggtccccggtccgggtaccccgtaccccgaacggtacccggttaacgggtttaccgacgggttcgggaccggtaagggttcgggggttacgtacgggggaaccgtaacggttaccctttaccgtaccgttacctacccgtaacccgtaccgtaccgacggtaccgtaaccgggtacccgtaccggggaaccgtacccggtttaggttaaaacggttttcggtttttacgggtttacgtttttaacgttacgttacgggttaaccgtaaccggtttaaccggttacgtaacccgtttaaaggtttaccggttaccttacgggttttaccgggacggtaaccgggtacgtaacggttacgtaagggtaccaacggttaccgaacggtaaccggttaggtaccgggttccgcgttaaccgacccgtacgttacgttcgttaaccgttctttaacggtccccttacccggttcccacgttaacg

SEQ ID NO: 107095 - DNA, 708 bp, Homo sapiens
  misc_feature: GYAE6OF01CFJGM.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgttctttgtctccgaggggacagagcccaccctctcctgcagggccagtcagagtaattaacactgcgcagcctggtgaccaacaaaaaccgtggaccaggcctcccgaggcctcctcatctttgactcgcctaccaagtcgggtccctggcgtcccgagcctaggttcaggtcggcgtaggtggggtcgtgggactagtacttccactctcacctacgtcacggcacggtccgtggacgccgttaggtaagttagtttttgggttacgtttttatttacgttggttacctaaggtaacccgtttcgaccgttaacgtttcgggttaacctttacggtttttccgggaaccggtaacgggggtaaccctaagggtaccgttagggtaacgtaacgtaccgaaacggtccgggtaaccgttcggggttacggacgttaccgggaacccgaaccttaccggttacctttacggtttaccctttacccgtttaacgtttccccgtttaacccccggccgtttaaacccg

SEQ ID NO: 107096 - DNA, 578 bp, Homo sapiens
  misc_feature: GYAE6OF01A6DS9.23.86.H09.1.454.CMB.1.raw
  modified_base (422)..(422): a, c, t, g, unknown or other
  misc_feature (422)..(422): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacactgcgcagcctggtgaccaaacaaaacctggaccaggctacccaggctcctcatctttgactgcctaccaatacgggtccctaggccgtccagccaggttcagtggccagtcgggtctggggacagcgttcactctacaccatcagcaacgcctagggactcctaggaagtacttttggtntttaactagtagtcaggtaaccgttgactaacgtcggtactacgttttcggaccgtagggaccaggtcaggagatacgaagcgtaaactggtacggctaggccaaccgtattccgttacggttaccttactaccgtttcccttcccgaccgttacg

SEQ ID NO: 107097 - DNA, 588 bp, Homo sapiens
  misc_feature: GYAE6OF01BNQPK.23.86.H09.1.454.CMB.1.raw
  modified_base (396)..(396): a, c, t, g, unknown or other
  misc_feature (396)..(396): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagagcccaccctctcctgcagggccagtcagagtattaacactgcgcagcctggtgaccaaacaaaaacctggaccaaggcctcccaggctcctcatctttgatgcctcaagtacgggtccctggcctccagcctaggtcaggtgcaggtgggtctgggacagtacttcactctcaccatcagcagcctggacncctagaagtagttttggtgtttattactgtactagtaccgttgactaacgttgtaactcgtttggaccgtaacggggacctagcgtaggaagtactacgaaggccgtaaacgttcgggtaggaccgttggaccctaaccgacttaccgttcgttcccgtttactacctttccccgttccccggccttaacgg

SEQ ID NO: 107098 - DNA, 859 bp, Homo sapiens
  misc_feature: GYAE6OF01DY45M.23.86.H09.1.454.CMB.1.raw
tcagacgcgagtatcacgaccggtgctcgatttagtgctatagacttggggtttgggggaggaactgctcagtcaggacccagagggaaccatggaagccccagctcagcttctcttcctcctgctactctggctcccagactaccaccggagaaattgtgttgacacagtctccagccctaccctgtctttgtctccgaggggacagacgcccaccctctcctgcgagggccagtcagagttaattaacaactgcgcacgccgtggtacgaccaaacaaaaaccgtcggaccacggcctcccgaggcctcctctattctttgactcgacctacgaagtcggtcctggcctaccgagcctaggttcgaggtggtacgtaggttcggggtacgttcggggaaccgtacggttaccttaccgtaacctccgttacccaacccgtatacccgaaacggccgtaacggtcccggtagggaccgtacccggttaaggttaaacggttttacgttttttacgggtttaacgtttttaacgttttaccggttaccggttaaccggttaaccggttaaacccggttttcgtaaccccgttaaagggttttacccggtttaaacccgttttaccggggttttttacccggggaaacccggttaaccgggggttaaaccccgttaaacgggttccggtttaacggggaaccgttaacgttaaccgggaaaaccgggtaccggttaaaaccgttgggggttacccgtacgttaaccgggtacccctaaacccgttacgttttaccccgttagttttacccctttaccgttaaacccgttttcccccgttccccgtaaccgtttaaacccg

SEQ ID NO: 107099 - DNA, 682 bp, Homo sapiens
  misc_feature: GYAE6OF01E4YZW.23.86.H09.1.454.CMB.1.raw
  modified_base (625)..(625): a, c, t, g, unknown or other
  misc_feature (625)..(625): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgtctccgaggggacagacgcccaccctctcctgcagggccagtcagagtattaacaactgcgcagcctggtgacccaaacaaaaaccctggaccaggcctcccgaggcctcctcattctttgactcgaccctaccaagtaccgggtccctgggcccgtacccacggccctagggttcgacgggttcggaccgtagggttcggggtacgtacgggaacctacggtaccctttctaccgttacctaccaacctacgtcaccgacacgtccgtacggtacctccgtaggtaaagtttagttttaggttagttttagttactcggtactaaccggtacgttcggaacctacggttacggtaccttacggtttccgggacgtacggggacctaaggtccgtaggaactacacggaacggtactaacgtgggtacgtcgtanaccctacgttacttcgttccgttccttaccaccgttccccgttcccgacgtttaacg

SEQ ID NO: 107100 - DNA, 648 bp, Homo sapiens
  misc_feature: GYAE6OF01CP7P1.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagagcccaccctctcctgcgagggccagtcagagtaattaacaactgcgcagcctggtcgaccaaacaaaaacctggaccaggcctccaggcctcctctatctttgactcgcctacaacgtacgggtccctggccgtcccagccgtacggttacaggtcggcgtaggtggggtacgtaggggactagtactttcacctcctccaaccgattccgagaccgtacgccgtaggacgtaccgtagtaagttagtttttgggtagttttaacttcgttagtacgtaacgtaaccgtttgacctaaacgttggtaaaccttcgttttacggaccggaacgggtaaccgtaaggtccgtagacgtacgtaacgacggtacgtaaacgtcggagtccgtgaccgtacctaagtcgttacgttcctttaacgcctttaacccgtcccgtctacg

SEQ ID NO: 107101 - DNA, 578 bp, Homo sapiens
  misc_feature: GYAE6OF01BU1U3.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgaccaaacaaaaacctggccaggcctcccaggcctcctcatctttgatcgcctccaatacgggtccctggccgtcccagccaggttcagtggcaggtgggtctgggacagtacttcactctcaccatcagcacgcctggacgcctagtaagttagttttggtagttttatacgttgtacgtagtaaccgttgacctaacgttggtaccttacgttttggaccgtaggggaacctaagcgtaggagacgtacgaaggaccgtaacgtggtacggtctgaccactatccgttacgttccttacacttcccttacccgcctaacg

SEQ ID NO: 107102 - DNA, 764 bp, Homo sapiens
  misc_feature: GYAE6OF01CN1WE.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagaaattgtgttgacacagtcctccagcccaccctgtctttcgtctccgaggggacagacgcccaccctctccgtgcgacgggccagtcagagtaacttaacaactgcgcagccgtggtacgacccaaaacaaaaaccgtcggaccaggcctacccgaggtcctcctcacttctttgactcgaccctaccgtaaacgtcgggtcccctggcccgtacccgacgccggtaaggttccgaggtcggacgtaggtcgggtacgtggggaacctacggtaccttccgaccttaccctaccgtaacccacgttccgaacggtcctaacgggtacccgtagggaccgtaacccgttaaggttaaacgtttaggtttttacgggtttagttttaacgtttacgttcggtaccttaaacggtaacgtttacgtaaccgttaacgttacgttaaccgttaacggttttccggaaccggtaacgggacctaacggtcggtaacggtaaggtactacggtaacggtaccgtaaccggttgtacgggtaccgttaccgacccgtacgttacggttaccttccggttacttacccgttaccttaccccgttcccgtaccgttaacgg

SEQ ID NO: 107103 - DNA, 811 bp, Homo sapiens
  misc_feature: GYAE6OF01ESWO5.23.86.H09.1.454.CMB.1.raw
  modified_base (207)..(207): a, c, t, g, unknown or other
  misc_feature (207)..(207): n is a, c, g, or t
tcagacgcgagtatcacgaccggtgctcgatttagtgctatagacttggggtttggggggaggaactgctcagtcaggacccagagggaaccatggaagccccagctcagcttctcttcctcctgctactctggctcccagactaccgacggagaaattgtgttgacacagtctccagcccacctgtctttgtctcgaggggacagngccatcctctcctcgcgacgggccagtcaagtaagttaacttaacaactggacgacgagtcccgttaggacgaaccaaaaccaaaaaccgtcggacccgaacggcctacccgacggtccttccgtacgtactttcgtttaggacttcggtaccctaccttaaacgggtaccgggttcccgtacgggtcccgtacccgtaccggacgttaacgggttcgaacggttcgggacgtacggggttcggggtaccgtaggggaacctacggtacctttacccgtaaccttacctaccgaaaccctacgtacggaacgtacggaaccggtcccggttacggaaccgtaccgttacgggttaaagttttaggttttacggttaggttttaaacttacgtttgtaaccgttaaacggttaccggttaccgtaacgtaacgtttcgggttaacctttacggttttccgggaaaccggtacggggtaaacctaacgggcgtaagggtaagtaacgtaacgaaagggtaccggtaaacggttggtcgtaccgtcgaaccctacgttacgttctttaccggttacctttacgtaacccttccggttaccccgtaac

SEQ ID NO: 107104 - DNA, 1010 bp, Homo sapiens
  misc_feature: GYAE6OF01CYPM7.23.86.H09.1.454.CMB.1.raw
tcagacgcgagtatcacgaccggtgctcgatttagtgctatagacttggggtttgggggaggaactgctcagtcaggacccagagggaaccatggaacgccccagctcagcttctcttcctcctgctactctcggctacccagactaccgaccggagtaattgtgttagacactacgtcctccacgccctacccttgttctttcgtcctaccggaggggacagacgcccacctctcctgacgacggccagtcaagtacgtaactaacacgtcgcacgacgtccgtaggtaccgaacccaaaacgtaaaccggtcgggacccaacggtccctacccgacggtccccttccttacgtacgtttcgtttacgaccttaccggtaccctaaccgttaaacggggttcccgggtccccgttacgggtcccccgtaacccgtaacggtaccccggttaaggtttccgacggggtcggtaccggtagggttcggggttacgacgggtaactacggtttacctcctacgttaccctaccaactcgtacacggaccgacgggtccgtacggggtaacctacgggtttaaggttaacgggtttttacttttttacggggtttactttttaaacctccggttaaacggggtttccgtaaaaccggggtttaacccgttaccgtaaacgggtttttaaacccgggtttcggttttaaacccggggttttaacccgggttttacccgggggggaaacccgggttaaacccggggggtttaaaccaccggggtttaacgggtaacgggggttaaaaccctttacggtaaacccgggggaaaaccggtttaacccgggttaaacccgggtttaccggggggtcccgttaaccggttaaaaccccggaacccccttttaacggtttaacgggtttttcccctttaaacccgggtttttccccccttaaacggttaccccgttttaacccccccggttcccccggttaaatttttaaaacccccggg

SEQ ID NO: 107105 - DNA, 600 bp, Homo sapiens
  misc_feature: GYAE6OF01ES94F.23.86.H09.1.454.CMB.1.raw
  modified_base (400)..(400): a, c, t, g, unknown or other
  misc_feature (400)..(400): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccaccctctcctgcagggccagtcagagtattaacactgcgcagcctggtgaccaacaaaaaccgtggccaggcctccaggctcctcattctttgactgcctaccgaagtacgggtccctggccgtcccagcctaggttcagtcggcaggtgggtctgggacagacttcactctcacatcagcagcctggacncgtagtagtagttttggtagtttatacgtgtactacgtaccgttgactacgttgtacttcgtttcggaccgtaggggacctaaggtccgtagggacgtacgtacgaaggtacgtaaaccgtggttacggtccgtacgacccgtaaccgtacgttccgttacggtttacccttacgtacctttcccgttccccgcttaacg

SEQ ID NO: 107106 - DNA, 697 bp, Homo sapiens
  misc_feature: GYAE6OF01A6ION.23.86.H09.1.454.CMB.1.raw
tcagacgcgagtatcacgaccggtgctcgatttagtgctatagacttgggtttgggggaggaactgctcagtcaggacccagagggaaccatagaagccccagctcagcttctcttcctcctgctactctggctcccagataccaccggagaaattgtgttgacacagtctccagccaccctgtctttgtctccgaggggacagacgcccaccctctcctgcagggccagtcagagtaataacaactgcgcagcctggtcgaccaaacaaaacctcggaccaggcctcccgaggcctcctcatctttgatcgcctacaacgtcgggtccctggcctcccacgtccgtagttcaggtcggccgtaggtcgggtctagggacacgtacttcacttcctcaccgtatacacggccacggccgttacgggacgtaccgttagaacgtttacgtttttaggtagttttaacgttaccgttggttaccgtaaacggttaaacccgtttgtaacccgttaagttaccggttaaccttacggttttccgggaaccggtaacggtaaccgtaagtccggtaaggaacgtacgtacgaaacggtcgaaaccggttggacggtccttagggtaccctaaccgttacgttaccgttacgtcccgttttaacccgtacccgtttaccccgtttccccgaaccgtttaccg

SEQ ID NO: 107107 - DNA, 573 bp, Homo sapiens
  misc_feature: GYAE6OF01BDU6Q.23.86.H09.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgaccaaacaaaacctggccagggcctcccaggctcctcatctttgatcgcctcaatacgggtccctggcctcccngccnggttcagtggcaggtgggtctggggacngacttcactctccacagtcagcagcctggcgcctgaagttattttgggttgtttatacttgtacgtacgtaccgttnaccgtacgtggtaacctcggttttcgggaccgtaacggggtaccaaggtcgtagggtanacttacgaagtaccgacgtggtcggctgccgacgtacttcgtacgttcctacgtcttcccttcccggcttaacg

SEQ ID NO: 107108 - DNA, 841 bp, Homo sapiens
  misc_feature: GYAE6OF01D4VG1.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctcagccacctgtcttgtctcgagggacagagccaccctctcctgcagggccagtcagagtattaacaactgcgcagtcctggtcgaccaaacaaaaccgtggaccaggcctacccgaggcctccgtctagttctttgactcgtaccctcctaaggtaccgggtccctgggccttacccgagcccgtaggttaccaggtcggaccgtagggtggggtacgtaggggacctaggtaaccttccgaactccttacgaacccatccgaacgggtccaacggccgtagggtacggtacccgttaggtaaacggtttacgttttttgggttaacgtttttaacgtttaccgttacgggtttaaccgtaaaccgggttaaaccccggttttagtaacccgttaaaccggttttacggggtttaaaccccgtttaacccgggtttttttaacgggggaaccccggttaaacgggggggtaaacccctaaaggggttaccggttaacggggtaaccggttaactttaccgggaaaaccgggtaccgtaaaaccgggtttagggttaccggggtaccgttaacggaccccgtaacccgttaacgttcccggtttaccggttttaccccgttttacttaaccccggtttcccccgtttccccccgggtaccctttaaaccgg

SEQ ID NO: 107109 - DNA, 664 bp, Homo sapiens
  misc_feature: GYAE6OF01A3DYB.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccaccctcgtcctgcagggccagtcagagtattaacactgcgcagctgtcgaccaacaaaacgtgaccaggcctccgagctcctcacttcgttgactcgcctacaagtcggtccgtggcctccgagccgtaggttcaggtcggctacggtggtcgtagggactagtaccttcaccgtctacacctagtcgacgtcgacgccgtaggactccgtaggtaacgtttgtttacggtacgttttactacgttacgtacgtacggttaaccgttggaacctacggttacggttaccttacggtttcggaccggtaacgggacctaagggtcgtaggaagtacgtacggaaacgacgttaaaccgtgggtaacggtcgtaccgaaccgtacccgttaggttaccctttacggttacccttaaccggttacccttccccctttccccggaaccgtttaaacccg

SEQ ID NO: 107110 - DNA, 769 bp, Homo sapiens
  misc_feature: GYAE6OF01AQ8A3.23.86.H09.1.454.CMB.1.raw
  modified_base (262)..(262): a, c, t, g, unknown or other
  misc_feature (262)..(262): n is a, c, g, or t
tcagacgcgagtatcacgaccggtgctcgatttagtgctatagacttgggtttgggggaggaacgtgctcagtcaggacccagagggaaccatggaagcccagctcagcttctcttcctcctgctactctcggctcccagactaccaccggagaaattggtgttgacacagtctccagccaccctgtctttgctccgagggcacgacgtccacccttctcctgcacgggcctagtccagacgttaattaaccacttgccgtnacgcctggtgaccctaaacaaaaaccgtcggaccgaacggcctacccacggtcctccgtactattctttagacttcgcctaccaacgtccgggtccctacggtccgtacccacggccgtacggttacgcggtggtaccgtagggttcgggtaccgtggggacctacgggtactttcacgttccgtacaaccgtactacgacggtccacgcccgttagaccgttaccaggtaacgtttacgtttggttacgtttaactttcgacgttacgtaacgttaacccggtttcgacgttaacgtcggttaactttaccggtttcggtacccgggttaaggggaacccttacggacggtttcgggtaaaccggacctttaacggaaaccgggttacgtacccggttaggttacccggacgttaccggaacccttaccttacggtttaaccgttccccgtttttacggtaaccccttttacggtccccccgtttttcccgaacgttttaaccccg

SEQ ID NO: 107111 - DNA, 674 bp, Homo sapiens
  misc_feature: GYAE6OF01A7R74.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagagccaccctctcctgcagggccagtcagagtattaacaactgcgcagcctggtgacccaaacaaaaaaccgtggaccaaggcctcccaggctcctcattctttgactgccctccgaagttacgggtccctcggccgtcccagccaggttcaggtggcaggtgggctgggacagacttcactctcacatcagcacgcctggacgtccgtagaagttagttttggtagttttaattacgtgttactaacgtaaccgttcgactaacgttcggttaacttacgttttacgggaccgtaaggggaccctaaggtcgttaacgggaacgtacgttaacgaaacggtaccggtaaacgttcgggttacgggtaccgttaccggaccgttaaaaccccgttgtttacccgtttacgggtttacccctttaaccttaacccggttttcccctttaccccccgggtaccctttaaccgg

SEQ ID NO: 107112 - DNA, 916 bp, Homo sapiens
  misc_feature: GYAE6OF01A5ERU.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagagcccaccctctccctgcaggggccagtcgagtagtattaacaactgcgcagcctggtcgacccaaaccaaaaaccgtcgggaccccaagggccctaccccgaagggtccttacccgtacctacgttcctttggaacttccggtaccctacccgtaaacggttaccggggtacccctcggggtcccggtaccccgacgccccggtaagggtttaccaagggtcggcgtaagggttcggggtcgtagggggaacctacggtaccgttactaccgttcctacccgtaaccccgtattacccgacgaccgtaacggtccccgtagggaccgtcccggtaaggtaaaggtttacgtttttaacggggtttacgttttaaacgtttaaccggtttcgggttaaccttaacgggttaaaccccggtttagtacccggttaaaccgtttacgggttaacccgtttaacccgggtttttacggggacccccgggttaaacggggggtaaacccctaacggggttaccgttaacggggtaaacgtaacggtaacccggtaaggtaaaccgggtttaaaccggtagggtttacccgggaccgttaccggggtaccccgtaaacccggttaacgtttaccccggttttacccggttacccgttttaccccggttaaccggtttttacccccccgtttaccccgggtaccccgttttaaacccg

SEQ ID NO: 107113 - DNA, 928 bp, Homo sapiens
  misc_feature: GYAE6OF01EJ623.23.86.H09.1.454.CMB.1.raw
tcagacgcgagtatcacgaccggtgctcgatttagtgctatagactttggggtttggggggaggaactgctcagtcaggacccaggagggaaccatggaacgccccagctcagcttctcttccctcctgctactctggcctacccagactaccacggagtaagttgtgttagacacgtacgtcctccacgccctacccttgtttctttcgtccgtaccggaggggacacggacgccctaccttcgcctggacgacgggcctagtacaaggttaacttaacttaaacacgtcgaccgacgacgtcgtacggtacaaaccctaaaacgaaaccggtccggaacccgacggtcccgttacccgaacggttccttaccctactacttttcgttacggacttccgtaacccgttaccgttaagggtccccggttcggtccggtcccgtaccggacggttaccggtttaacggtcggtaacgggtcggtccgttaagggttccggggtacggacggtaaacttcgttaccttccgtacctcgtaaccacgtcgtaacgacgtccggaccggttacggtaccgggtacgtaacgggttaaggttttaacggtttaagttttttacggggtttaattttttacgggtaaccgttttacggtaaacccgggtttaaccggttttaaccgggttacggttaaacccgtttaacgggtttttaccgggttttacccggtttttaacggggttaaccgggggaaccccgggttaacgggtaaacgtacgggttccggttaagggtaaccgtaaccgttacgggtaacgggttaacccggtaccgtgggtacggttacccgacggttaaacccttgggttctttaccgtttaaccgtttacttccccttaaccggtttccccttacccgtacgtttacccg

SEQ ID NO: 107114 - DNA, 777 bp, Homo sapiens
  misc_feature: GYAE6OF01C26PA.23.86.H09.1.454.CMB.1.raw
  modified_base (583)..(583): a, c, t, g, unknown or other
  misc_feature (583)..(583): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctccagactaccaccggagaaattgtgttgacacacgtctccagccacctgttctttgtctccgaggggacagacgcccacctctcctgcgacgggccagtcgaagtagtaattaacgaactcgacgcgacgccgtgggtacaaccctaaaacgaaaaaccgtggacccgaacggcctacccgacggtcctcccctactactttcgttttacgacttccggtcccttaccgaaagtttacccggggtcccgttacgggcccgttcccaaggtcccgtaaggttccgacggtacggcgtacgggtcgggttacggtcgggaacgtacggtacctttacgacttccgtaccaaccgtagttacacgtacgtacgtcgtacgggactccgttaggttaacgtttaggtttttggttacgttttacgttacgtagtacctaggttaaacccgttnaacccggttaagttcgttaacccgggtttacttttccggggaaccgttaacgggggacctaacgggtacggttacggagtaaccgttacgaacggttaaccgtaacggtcggggtagtacctacggtaacttccggttaaccgttcgtttaacgtccgttttaccaccggtttccccttaaccggctttaaacg

SEQ ID NO: 107115 - DNA, 892 bp, Homo sapiens
  misc_feature: GYAE6OF01C5AON.23.86.H09.1.454.CMB.1.raw
  modified_base (785)..(785): a, c, t, g, unknown or other
  misc_feature (785)..(785): n is a, c, g, or t
tcagacgcgagtatcacgaccggtgctcgatttagtgctatagacttgggtttgggggaggaactgctcagtcaggacccagagggaaccatggaacgccccagctcagcttctcttcctcctgctactcgtggcctccagtacttccgaccggactaaattgtgttagacactagtcctccacgccctacccgttgttcgtttcggtaccggtaccgggggaacaccgtcccctacccttccgtaccgtcggaccggaccggggcccggaccgtaaggtaccgttcggtaacgaaccgtaaaccggtacgttaccgtaccggttaacggtaacccgaaacgtacgaacgtccggtaccggaccgtacggccctacccggtacggtccctaccgttcacttaccgtaacgtacgtacctttaaccgtaccggtaacggtaccgggtacctaccggtcggtacctaacccgtacccggtaccgtccccgtagttaccggaacgggtccggacgtacgggggtcggtacggtacgggtaactaacgttcctacccgtaccgtacctaaccgtaccgtaacctacccgtaacgaccggtaccgttaacggtaccggttaaccgtaggtttaacgtttcgtttaacggtactttaacggtttacctacggttactaccggtaaccgttaccggaaacggtaacgggttaccgtacccgtaaccgtaccttaatttcccgtttaaccggtcccgtttaccggaaccggtaacggtaacgtaaccggttanaaaccgtttaacgaacgtaaaccggttaggtacggtccgtacgtaaccgtacccttaacttcttccgttaccgttacttcccggtaccctttcccgtcgttaaaccc

SEQ ID NO: 107116 - DNA, 705 bp, Homo sapiens
  misc_feature: GYAE6OF01AONPR.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccacctctcctgcgacgggccagtcagaagtattaacactgcgcagccgtggtacgaccaaactaaaaccgtggaccagggcctcccgaggcctcctactactcgtttgatcgcctaccgaaagttcgggtcctgggaccgtcccgagccgtaggttcagggtcggacgtacgggttcgggttcaggggacctaggtacctttcgacctcttcgaacctatcgaacgtcacgccgtgggacgtccgtaaggtacgttagtttttcgggttacgttttaactttacgttacgtaccgtaacggttaaccgtttcgacgttaacgttacggttaacgtttcggtttttacgggaccggttaacgggggaaccctaacgggtccgttaggacgttaacgacggtaaacgaccgggtaaacggttggtacggcgttagaccgaccgtttagtacccttcgggttaccttacgtaaccctttcccggttaacccgtcgtaacg

SEQ ID NO: 107117 - DNA, 881 bp, Homo sapiens
  misc_feature: GYAE6OF01AC4OP.23.86.H09.1.454.CMB.1.raw
  modified_base (151)..(151): a, c, t, g, unknown or other
  misc_feature (151)..(151): n is a, c, g, or t
tcagacgcgagtatcacgaccggtgctcgatttagtgctatagacttgggtttgggggagaactgctcagtcaggacccagagggaaccatggaagccccagctcagcttctcttcctcctgctactctcggctcccagactaccacgganaattgtgttcgacacagtcctccagccctaccttgttctttgtcctaccgaggggtacacgtaccgacccctacccttcctccgtcggacggacgggtccaggtcaagtacgtaacttaacacgtcgacgcgacgtccgtggacaaccaaccgaaaaccgtcggaccgacgcctaccgacgtcctcctactactttacgttacgtaccgtaccgtcccgttaaccgtaaccgggttacccgggtttccccgtaccggtacccgtaccccgtacggttaccccggttagggtttaccgtacgggtaccggtaacggtacggggtttcgggtaaccgggtttaccggggaacccgttaacggttaccccgtttaacctacccgttaacctacccgtaaccgtacgtacgacgggtaccgaccggtcgggttaacgaccgggttaccgtttagggttacgttttaacggttttacggtttaactttaacggttaccgttacggtaaccgttaaccgggttaaccgtacgttaaccggtaacgtttaccggttaccggttttaaccggttcgggtaacccggtaacggggtaacgtacggtacgggtacgacggttaaccgtaaccggtacgacgggttaccggtacggtacgaccgtttaccgaccttcggttaccttaagtttcccgttacttaccccgttaccgttccccgttaaccgttcgttaacccgg

SEQ ID NO: 107118 - DNA, 728 bp, Homo sapiens
  misc_feature: GYAE6OF01BP8XL.23.86.H09.1.454.CMB.1.raw
  modified_base (691)..(691): a, c, t, g, unknown or other
  misc_feature (691)..(691): n is a, c, g, or t
tcagacgcgagtatcacgaccggtgctcgatttagtgctatagacttgggtttgggggaggaactgctcagtcaggacccagatggaaccatggaagccccagctcagcttctcttcctcctgctactctggctcccagataccaccggagaaattgtgttgacacagtctccagcccacctgttctttcgtctccgagggacagacgccaccctctcctgcagggccagtcagagttaacttaaacacgtgcgcacgccgtggtacgaacctaaaacgaaaaccgtcggaccaacggtccctcccgacggtccttcctactattcgttagctcgtacctacgtaacggtccgggtccctcgggccctaccgacggtccgtacgggttacgtagggtcggtaccgtagggttcggggttacggtacggggtaacctaacggttaccttacctacccgtacctacctaaccagtacgaccggtccaacggtccggtaggaccgtcgttaaaggaacgttttgttttaggttattttaacgtactttacgtacgtaaccggttacgttacggaccttaacggtttcgtaccgttttacggtttacgggacccggtaaggggaacctaggacggttaacggaacgtactaccggagttaacccgaggttcggcgtacgtacgaccctaaccgtntcgttcttaacctacttcccgttacccgtccctaacg

SEQ ID NO: 107119 - DNA, 618 bp, Homo sapiens
  misc_feature: GYAE6OF01AWS61.23.86.H09.1.454.CMB.1.raw
  modified_base (548)..(548): a, c, t, g, unknown or other
  misc_feature (548)..(548): n is a, c, g, or t
  modified_base (580)..(580): a, c, t, g, unknown or other
  misc_feature (580)..(580): n is a, c, g, or t
  modified_base (610)..(610): a, c, t, g, unknown or other
  misc_feature (610)..(610): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagatacccaccggagaaattgtgttgacacagtctccagccaccctgtctttgtctccaggggacagagccaccctctcctgcacgggccagtcagagttattaacaactgcgcagcctaggtgaccaaacaaaaaccgtcggaccaggcctcccaggctcctcatcttgatcgcctcaagtcgggtccctggcctcccagcctaggttcagtcggcgtaggtgggtcgtggggacctagaccgtttcactccgtaccactactcgagcacgtccgtgggactcctaggtaagtttagttttcggtattttaacgttaacgtgttaccgtacggtaaccgtttcgacctaagttccggttaacctacgttttccggaccggtaacggggaccctaaggtcgtaggtaacgntacgagacggtaactgtacggctgaccgtacnttccttacgttcttcccgtaccttcccgtntcgttacg

SEQ ID NO: 107120 - DNA, 794 bp, Homo sapiens
  misc_feature: GYAE6OF01B0M2R.23.86.H09.1.454.CMB.1.raw
tcagacgcgagtatcacgaccggtgctcgatttagtgctatagacttggggtttgggggaggaactgctcagtcaggacccagagggaaccatggaagccccagctcagcttctcttcctcctgctactctggctcccagactaccaccggagtaaattgtgttgacacagtctccagccacctgtctttgtctccgaggggacagacgcccaccctctcctgcgagggccagtcagtagtattaacactgcgcagccgtggtacgaacctaaacaaaaaccgtcggaccgacggcctaccgaggcctcctctagttcctttggacttccgtaccctaccgtaacgttacgggtccctgggcccgttacccgacgtccgtaggttcgagggtggccgtaggttcggggtcgtaggggaacctacggtaccttcgtaccttccgtaccacctaagtccgacgacgtacggtaccgtgggaccgtaccgttaaggttaacggttacgttttttagggttactttttaacgttaccgttacggttaacgttaacgggttaacccgttaggtaaccgttaaacggtttcgggttaaccgtttaccggttttaccggggaacccggtaaccggggtaaccctaaagggttccggttaagggaaacgtacgggtaaccgtaacggggtaaccgttaaacggttcgggtaccggtacgttaccgaacccgttaccgtaacgtttcccttacggtttaacccttcttaaacccggttttccccgtacccgtcctttaaacgg

SEQ ID NO: 107121 - DNA, 777 bp, Homo sapiens
  misc_feature: GYAE6OF01EOQFS.23.86.H09.1.454.CMB.1.raw
  modified_base (249)..(249): a, c, t, g, unknown or other
  misc_feature (249)..(249): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtcctccagccacccttgtctttgtctccgaggggaccagacgccaccctctcctgcagggccagtcagatataacactgcncagcctggtcgaccaaacaaaaacctggaccagctccagctctcattctttgactcgtcctacctaagttacgggtccctcgggtccgtacccgacgtaccgtaggttcaacggttcgggacgtagggttcggggttaccggtacggggaacctacggtaaccctttacctaacccgttcccgttaaccgaaccccgtaacttaaccgaaccgaccgtacggtcccggtaggtaccggacccgttagggttaacgtttaggtttttacggtttagtttttaacgtttaacggtcgttaacctaacggttaacccgttacgtaaccgttaacggttaaggtttacccgttacggttttaccggggaacccgggttaacgggggaaccccgttaaagggccgttaaggggtaacgtaacgtaacggaaacggtaccggtaaacgttgggttacggtccgttacggaaccttccggtactttaccgggtactttccgttacgtacccttcccggttaacccctgttaaccg

SEQ ID NO: 107122 - DNA, 749 bp, Homo sapiens
  misc_feature: GYAE6OF01DEIR9.23.86.H09.1.454.CMB.1.raw
  modified_base (390)..(390): a, c, t, g, unknown or other
  misc_feature (390)..(390): n is a, c, g, or t
  modified_base (552)..(552): a, c, t, g, unknown or other
  misc_feature (552)..(552): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagtaaattgtgttgaacacagtcctccagcccaccctgtctttgtcctccgaggggacagacgcccaccctctcctgcagggccagtcagagtataacaactgcgcagtcctggtcgacccaaaacgaaaaaccgtggacccgaacggcctcccgaaggtccctcctacacttctttaggatcggaccctacaagttacggggtccctggcccgtcccgagccgtacggttcaggtcggngacggtcgggtctaggggacctagtaccttcgacttccgacacccgtataccaacggcctacgtacccggtcggaccgtacccgttaaggtaacggtttaggtttttgggttacgtttttaacgttacgtaccggttacgtaacggttaaacccgggtttanaaccggttaaacgttacggggttaaccctttcgggtttttaaccgggacccgggttaacggggtaaaccccgtaagggtacccggttagggtaacgtacggtaaccggtaaacggcccggttaaaccggtgggtaacggtcgtacgactacccgtattcctacggttccttacgaccgtttaccctcccgtactacg

SEQ ID NO: 107123 - DNA, 791 bp, Homo sapiens
  misc_feature: GYAE6OF01DE6Y5.23.86.H09.1.454.CMB.1.raw
  modified_base (272)..(272): a, c, t, g, unknown or other
  misc_feature (272)..(272): n is a, c, g, or t
  modified_base (484)..(484): a, c, t, g, unknown or other
  misc_feature (484)..(484): n is a, c, g, or t
tcagacgcgagtatcacgaccggtgctcgatttagtgctatagacttggggtttgggggaggaactgctcagtcaggacccagagggaaccatggaacgccccagctcagcttctcttcctcctgctactctcggctcccagactaccgaccggagtaaattgtgttagacacagtcctaccacgccctacctgttctttcgtcctccgagggacacgcgccccaccgtctcctgacgacgggcctagtcgagtagtaactaacacgtcgcncgagtccgtggtacgaaccaaaccgtaaaaccgtcggaccgacggccctacccgacggtccttaccctactacttccgttttacgacttccgtaccctaccgtaacggtccgggttcccgtcggacccgtaccgacgtcccgtaggttacgtacggcggtacgtaggtcgggtacggtggaacgtacgtacgtccgtacttccgacacctanaccgtacgacgtaccggacgtcggtacgtaccgttaggttaacgtttggttttaggtaccgtttaacgttacgttacggtaacgttaaccggtaccgtttacgaaccggttaacgtacgggtttaaccttaccgggtttaacgggacccgggtaacggtaaacccgtaaggtaccggtagggtaacccgtacggttaaccggtaacgtaaccggtacggtacgggttacggtacctaaccgggtacctacgttacgttccgttacccgtttactacccggttcctttaccccggctaccgtttaccg

SEQ ID NO: 107124 - DNA, 813 bp, Homo sapiens
  misc_feature: GYAE6OF01EKIU7.23.86.H09.1.454.CMB.1.raw
tcagacgcgagtatcacgaccggtgctcgatttagtgctatagacttgggtttgggggaggaactgctcagtcaggacccagagggaaccatggaacgccccagctcagtcttctcttcctcctgctactctggctcccagactaccgaccggagtaaattgtgttgacacagtcctccacgccctacccttgttcttttgtcctccgaggggacacgacgcccaccctcctcctgcgacgggccagtcagtaacgttaattaaccaacgtgccgcacgccgtcggtacgaccaaaccgaaaaccgtcggacccacggtccctacccgacggtcctacctctactttctttgactcgtaccctaccgtaaggttaccgggttcccgtccggtcccgtacccgacgtccggtagttccgagggtcggcggtaggttcgggtcggtacggacgtaacgtccttacgtacctacgtaccaacctagtaccgacggaccgtaccggtccgtagggtaccgtaccggagtttaacggttttagtttttacgggtttagttttaacgttacgtttaccgggttaaccgttaacgggttaaccccgtttacggtaaccgttaaaccggttttccggttaaccgtttacccggttttacccgggaaccggggtaaaccgggtacgtaacggtcggttaagggtaaccgtacgtaacggaacgtccggttacgtagggtccggtaccgttccggacccttaaaccggttcgttccgtttccgttaactttccccgtacctttcccttacccgtccttaacgg

SEQ ID NO: 107125 - DNA, 671 bp, Homo sapiens
  misc_feature: GYAE6OF01CC8M6.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagaaattgtgttgacacagtctccagccaccctgtctttgtctccgaggggacagacgccaccctctcctgcgacgggccagtcagtagttaacttaaccaacgtgccgcgagtccgtggtcgacccaaaaccgaaaaccgtcggacccagggtccctacccgaggccttccgtactattcctttagactcgtccctaccgtaacggtcggtcccgtcggcccgtcccgacgccgtagggtctaggtcgggccgtaggtcgggtacgttcgggtacgggaactcgtaaccgtttccaccttacgtacctaccgatccgacgacgtacggttccggtacctacccgtaggttacgtttagtttcaaccgttagttttaacttcgtcgtacgacgacggtacgtccgccggtccgtcgtaccttacgtcccgtacgttcccggaacggacgtcgtaccggagtacgagtacgaacggacgtacgtgacggtcacgctactgttctactcttacgccgttcccg

SEQ ID NO: 107126 - DNA, 1011 bp, Homo sapiens
  misc_feature: GYAE6OF01BIQCC.23.86.H09.1.454.CMB.1.raw
  modified_base (163)..(163): a, c, t, g, unknown or other
  misc_feature (163)..(163): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccacggagtaaattgtgttnacacagtctccagccacctgtcttcgtctccgaggggacagacgcccaccctctcctggcgaggccagtcgaagtagtaacttaaccacgtgcgctacggtccgtaggtacgaccgaaaccgtaaaaaccgtccggaccgtacggtaccctacccggacggtaccctaccttccgttacgtttacttttcggaacggttccctacccgttacctaacggttaaccggggttccctacgggacccgttacccgacggtacccgtaacggttaccgaggttaccgggacgtacgggttcgggttaccgttacggggtacctaacggtacccgtttacgtaaccttaccgtaccctaaacccgtaacgtccgtaaccggtaccgtaccgggtaccccggttagggtaacccggtaccgtttaaacggtttaacggttttaaacgggtttttcggggtttttaaccggttttaaagtttaacccggttttccgggtaacccgtttaaaaccgggtttaacccggtttaccggttaacccgttaaaccgggttttaccggttaaaccggtttttaacccggggtttaccgtaaccccggggggttaaacgggggttaaaccccctaaggggttttacccgggggaaaggtttaaccccgggttaacgttaaacccgggtaaccgggttaaccgttaaaacccggggttaggttacccgggttacccgggttaacgtaacccccggttaaacgggttaacccgttttacccggttttaaccccggttttaccctttaaccccggtaaccccggtttttttacccccgaccccgggtttcccggttttaaacccg

SEQ ID NO: 107127 - DNA, 841 bp, Homo sapiens
  misc_feature: GYAE6OF01AV3G0.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagacgccacctctcctagcagggccagtcagagtattaacaacgtgacgcagcctggtcgaccaaacaaaaaccgtggaccaagggtcctacccgaggcctcctacacttcctttaggacttcgcccttaccgaagttaccgggtccctgggtaccgttccccgaaggtcccgtaaggtttccaagggttcggccgtaacggttcggggttccgttacggggaaccgtaacggtaacccttttccggaacttcccttacccgaaccctaaacgtttccacgggtaccctaacgggtcccgtttaacgggaccggtacccgttaagggtaaaccgttttaacggtttttttagggttaacggttttttaaacttaccgtttaccggtaaccgttaaacgggttaaacccggtttacgtaacccgtaaacgtttcgggtaaaccgtttaacggtttttccgggaaacccggttaacgggggtaaccctaaagggtcccggttaaaggtaccgggttaataaccccgggtaaaggtccgtaaaacccgttggggttacggtaccgtacgggtaccctaaccgttaacgttcgtaaccggtttccttaccggtaacctttccgttacccccgtacgttaacccg

SEQ ID NO: 107128 - DNA, 670 bp, Homo sapiens
  misc_feature: GYAE6OF01BQWVQ.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccaccctctcctgcacgggccagtcagagtattaacactgcgcagccgtggtcgccaaacaaaaacctggaccagggcctcccgaggctcctcattctttgatcgacctccaagtacgggtccctggccgtcccagcctaggttcagtggcctaggtcggggtctaggggacacgtaccttcgacctcgtaccacctagtcgatccgagcccgtggacgtcccgtagtaaacggttacgtttttgggtactttttacgttaccgttggttacctaacgggtaacccgtttgaacccgtaacgtttgggttaaccttacgtttttcccggggaccgttaacggggtaacccaaggtaccgttagggtacggacttacgaaacggtccgtaaaccgtggttcggcgttgaccctaactaccgttcgttacgttccttacgactttccccgttacccgccgttacg

SEQ ID NO: 107129 - DNA, 666 bp, Homo sapiens
  misc_feature: GYAE6OF01EQEB6.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccagggggacagacgcccaccctctcctgcacgggccagtcagagtattaacactgcgcagccgtggtgaccaaacaaaaacctggaccaggcctcccaggcctcctcattctttgatcgcctccgaagtcgggtccctggccgtcccagccgtaggttcgagtcggctaggtcgggtcgtgggacagtacttcgactcgtacacatcagcacgcgtggacgccgtaggtaagttacgttttaggttacgttttatttacgttcgttaccgtaacggttaaccgtttaggaaccgttaacggtttcggttaacttacggttttacggggacccggtaacgggggtaacctaacgggtcgttaggggtaacgtagttaccgaaacggtacggtaaaccgtgggttacggccgttggaaccctaccgtacgttcgttacgttccgttactacccgttcccgttccccgccttaccg

SEQ ID NO: 107130 - DNA, 799 bp, Homo sapiens
  misc_feature: GYAE6OF01AUDOG.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccacggagaaattgtgttgacacagtctccacgcccaccgtgtctttacgtctccgaggggaacagacgccctaccctctaccgtgcgacgggccacgtcgaagtacttaacttaaactaaccttcgaccgtacgacggtccgttacggaccaacctaaaccgtaaaaccgtcggaccgtacggtccctaccggtaccggtccttaccgtcttacttcgtttacgacgtcgtaccctaacctaacggttaccgggtccccgtacggtccgtacccgtacgacccgttagggtccgaggtacggtcggtaaggtccggggtacgtacgggacggtacggtaaccctaccggtacttacccgtctaacctactaccgacgtccgacgttccggacgtacgtaccgacgttaacggttcgttttacgggttacgtttaacgtttacgtttacggtaccgttaaccggtacgttacccgggttactaacgggttacggttccgttacggttttacgggacccggtacggtaccggtaacggttaccggtacggtaccgtacgggtaaccgtacggtaccgggtagtcgggacccgtaggtccaaacttcggactaccggttctacgttcccgtacgtttccccgtacgtcgtttaaccgg

SEQ ID NO: 107131 - DNA, 804 bp, Homo sapiens
  misc_feature: GYAE6OF01A7PGO.23.86.H09.1.454.CMB.1.raw
  modified_base (251)..(251): a, c, t, g, unknown or other
  misc_feature (251)..(251): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagaaattgtgttgacacagtctccagccaccctgttcctttgtctccgaggggacaggacgccaccctctcctgcagggccagtcagatattaacactgcncagtccgtggtcgacccaaaccaaaaacctggacccaagggccctacccgaagggccttcccgtactacgttcctttagactcgtcccttaccgaagttaccggggtcccctacgggtccccgttacccgacggtccctaacggggttttcgagggttcggccggttaagggttcggggttacgtacgggggtaaccaacggttcccgtttaccacctttccctaccgtaacctacttcccggaacgtcccgaacggttcccgtagggaccctaccgggttagttaaacggtttgtttttacggggttatttttaacgttaccgttcgggttaccttaaccggtaaccggtttaccgaccttaaccggtttacggttaaccgtttaccggttttccgggtacccgggacggggtaacccgtaaccggttcgtacgggtaaagccgttaaccggaaggtacccggtaacggtcgttaccgggcgttaggaccttacccgagtttcgttacccggttactttacccgtaccctttccgtccccgtcgttaacccg

SEQ ID NO: 107132 - DNA, 735 bp, Homo sapiens
  misc_feature: GYAE6OF01BTJTE.23.86.H09.1.454.CMB.1.raw
  modified_base (603)..(603): a, c, t, g, unknown or other
  misc_feature (603)..(603): n is a, c, g, or t
  modified_base (662)..(662): a, c, t, g, unknown or other
  misc_feature (662)..(662): n is a, c, g, or t
  modified_base (690)..(690): a, c, t, g, unknown or other
  misc_feature (690)..(690): n is a, c, g, or t
tcagacgcgagtatcacgaccggtgctcgatttagtgctatagactttggggtttgggggaggaactgctcagtcaggacccagagggaaccatggaacgccccagctcagtcttctcttccctcctgcctactctggctcccagactaccaccggagaaattgtgttgactacagtctccgacgccctaccctgttctttcgtctccgagggacagacgccctaccctcctccgtgaccgacggcctacgtacgtaagtaacgttaacttaaaccaacgtcggaccgcgacgtccgttcggtcgaaacccgtaaaacctaaaaccggtcggacccgtacggccctaccgacggtcccttacctcttacgtttcttagcgtaccgtacccgtaccgtacggtaaccgggtcccgtcggtacccgtacccgtacggtaccgttaggtacgtagggtcgtacggtacgggttcgggtaccgtcggggaacctacgtacccttacgtaacctcctacccaccgtacgtacacgtcacggtcctagggactccggtaaggtttagtttgttttgttatttacgttcgtacgtacgtaagtacccgtnacgtactgtaacgttcgtacggacggaacggctaacggtgtacgaagcctagaaccggngttaacggtcgtacggctcgtaaccgtntacgtttcgtacgttccttaacgtccccttccgtacccgtattcg

SEQ ID NO: 107133 - DNA, 857 bp, Homo sapiens
  misc_feature: GYAE6OF01AQBBW.23.86.H09.1.454.CMB.1.raw
tcagacgcgagtatcacgaccggtgctcgatttagtgctatagacttggggtttggggggaggaactgctcagtcaggaccagagggaacatggaagcccagctcagcttctcttcctctgctactctggctccagactaccacggagtaaattgtgttgacacagtctcagccacctgttcttgtctcgagggacagacgccacctctcctgcgacggcagtcagtagtactaacactcgcgcacgtcgtggtacaaccaaacgaaactcggccgacggtacctaccgacgcctccgtctactttacgtttcgacttcgtaccttaccgtaaggttccgggtaccgttcgggaccggtaccgtacggtaccttacgggttacgtaacgggtcgggccgttaggggttcggggtcggttacgggggacctaacggttaccgtttaccgtaaccttctaccccgtaacgttaccgtacgtaaccgggtaccgtacggtaccggtacgggtaaccgttaccgggttaacggttaaacggtttttacggttttacgggggtttttacttttaaaccggttacggtttaccgtttaacggtaacggttttaacccggttacggtaacccgttaaccgggttttacgggtttaaacccggttccggggtttttaaaccgggaccgggggttaaaccgggggtaaccgttacgggtaaccgggtttacggaacggttaacgtaaccgggaaaccggttacgtaaccggttgggtacccgggtctacggtaaccctacgttacgtttcccgttacgttcccgtttacgttaacccggttcccgtttaaccgtccgtttaaccgg

SEQ ID NO: 107134 - DNA, 721 bp, Homo sapiens
  misc_feature: GYAE6OF01AYKD2.23.86.H09.1.454.CMB.1.raw
  modified_base (221)..(221): a, c, t, g, unknown or other
  misc_feature (221)..(221): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagaaattgtgttgacacagtctccagccaccctgtctttgtctccgaggggacagacgcccaccctctccngcgagggccagtcagagtattaacactgcgtcagcctgggtcgacccaaaactaaaaaccgtcggacccacgggccctacccgaggtcctcctctaacttcgtttacgacttcgccctaccgtaaggtaccgggtccctacgggcccgtacccacggtcccgtaagggttccgagggtccggtcggtacgggttcggggtccggtacggggacctaacggtacctttccaccgttaccctaccaccgtatcgacaccgacgtccgtagggaccgtccgttaaggtaacgtttagttttaggtattttaacgttacgtacggttacgaacgttaaccgttgtacctaacgttcggttaaccgttacgtttaccgggaccggtaacggggtaaccctaggtacgttacgggaagtaacgtacgaacggtaccgtagtcgggtacgtcctacgaccgtcttacgtccgttacgttccttacgtacccttccgtcccctcgtac

SEQ ID NO: 107135 - DNA, 845 bp, Homo sapiens
  misc_feature: GYAE6OF01CJ2EC.23.86.H09.1.454.CMB.1.raw
  modified_base (228)..(228): a, c, t, g, unknown or other
  misc_feature (228)..(228): n is a, c, g, or t
tcagacgcgagtatcacgaccggtgctcgatttagtgctatagacttggggtttgggggaggaactgctcagtcaggacccagagggaaccagtggaacgccccagctcagcttctccttcctcctgctactctggcctcccagactaccacggagtaaactttgtgttgacaacagtcctcacgtccctacccgttgttctttcgtctaccggagggaccaggaccnccctaccctcgtcctgccgacggccagtcgagttaattaactaacgtacgtcgacgacgtacggtccgtggaacctaaccgaaaaccgtaaaacccggtcggaaccgacggtacccgtccgtacgtcccttacccgtactacgtttacgttcgtaccgtccgtcccgttaaccggtaaaccggttcccggtcccggttaccggtacccgtccccggacggtacccgtaggttccggacgggttcggtaaccggttgggttacgggtcgtaacggtaccgtaacgttcctacccgtactccctaaaccgtacctaactaaccgactccgggtacggtcgtaaccggtacgttcgttaaggttttcgttttgtttacggttttaacttacggtcgttaaccgggtaagtttccgtaacggtaaccgttaacgtttaacgttaccggtttaccgttcggggaaaccgttaacggggtacctaacgggttcgggttaacgaacgttacgtacgggtaacgacggtttaccggagggttccgtaaccggtcctaaccggtcttaccgtttgttaccccgttatccgtttaaccccgtattccccgtaaactgtttaacccgg

SEQ ID NO: 107136 - DNA, 524 bp, Homo sapiens
  misc_feature: GYAE6OF02IGZL8.23.86.H09.1.454.CMB.1.raw
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (521)..(521): a, c, t, g, unknown or other
  misc_feature (521)..(521): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaaacaaaacctggccaggcctcccaggctcctcatctttgatgcctccaagtacgggtccctggccgtcccagccaggttcagtggcaggtgggtctgggacagacttcactctcaccatcagcagcctgggancctagaagtnttttggtntttattactgtcagtaaccgttgactaactggtactcgttttggccgtaggggaccaagcgtaggagatacgaagcgatgtggctgcacatctgtcttcattcctcccgntac

SEQ ID NO: 107137 - DNA, 603 bp, Homo sapiens
  misc_feature: GYAE6OF02HD4Z4.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatagggtccctggctcccagccaggttcagtgcagtgggtctgggacagacttcactctcaccatcagcagcctggagcctgaagtattttggtgtttattactgtcagtaaccgttgactaacgtggtacctacgttttgggaccctaagggggacccaaaggtccgtagggaacgtaacgttaccgaagccgtaacgttgggttacgggtccttacgggaccctaacccgtaagtttcccgttacggttacccttttcgaaccgtttccccgtttacccccggtacccttaacg

SEQ ID NO: 107138 - DNA, 519 bp, Homo sapiens
  misc_feature: GYAE6OF02GILYF.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaacctggccaggctcccaggctcctcatctttgatgcctccaatagggtccctggcgtcccagccaggttcagtggcagtgggtctgggacagacttcactctcaccatcagcagcctggacgcctgaacgtattttggtgtttattactgtcagtaaccgttgactaactggtactacgttttggacctaggggaccaagctggagatcaagcgactgtggctgcacctatctgttcttcatccttcccgctac

SEQ ID NO: 107139 - DNA, 516 bp, Homo sapiens
  misc_feature: GYAE6OF02F8E9M.23.86.H09.1.454.CMB.1.raw
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctgactcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatagggtccctggcgtcccagccaggttcagtggcagtgggtctgggacagacttcactctcaccatcagcagcctggagcctgaagtatttggtagtttattactgtcagaaccgttgccaactggtactacgttttggccgtaggggaccaaggctggagatcaagcgactggtggctgcaccntcngttcttcatccttccgctac

SEQ ID NO: 107140 - DNA, 593 bp, Homo sapiens
  misc_feature: GYAE6OF02ILAYJ.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggaccaggctccccaggcctcctcatctttgatcgcctccaatacggtccctggccgtccagccaggttcagtcggcagtgggtctgggacagacttcgactctcaccatccagcagccgtggacgcctgaagtattttggtgtttatactgtcagtaaccgttgactaagtggtactacgttttggaccgtaggggtaaccaagtccgttaggaacgtagtacgaaggaccgtaaacgtggtacggcttacggcccaaccgtaacgtttccttacggtttacctttaccgtaacctttcctttaccccccggacctttaacg

SEQ ID NO: 107141 - DNA, 552 bp, Homo sapiens
  misc_feature: GYAE6OF02IMP1W.23.86.H09.1.454.CMB.1.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatagggtccctggcctcccagccaggttcagtggcagtgggtctgggacagacttcactctcaccatcagcagcctggagcctgaagtnttttggtntttattactgtcacgtaaccgttgactaacgtggtacctcgttttggaccgtaggggacccaaggccttagggagtatacgaagacgaacgtggtcggcttagccgtaacctagtcgttgttccttcaacgttcccttcccgcctacg

SEQ ID NO: 107142 - DNA, 520 bp, Homo sapiens
  misc_feature: GYAE6OF02HC6HQ.23.86.H09.1.454.CMB.1.raw
  modified_base (407)..(407): a, c, t, g, unknown or other
  misc_feature (407)..(407): n is a, c, g, or t
  modified_base (505)..(505): a, c, t, g, unknown or other
  misc_feature (505)..(505): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatacgggtccctggccgtcccagccaggttcagtggcagtgggtctgggacagacttcactctcaccatcagcagcctggacgcctagaagtatttggtntttattactgtcagtaccgttgacaactggtactactttggcctaggggaccaagcgtagagatacaagcgaactgtggctgcactatcgtgttcttnactccttcccgctac

SEQ ID NO: 107143 - DNA, 602 bp, Homo sapiens
  misc_feature: GYAE6OF02GO897.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttccctcctgctactctggctcccagataccaccggagaaattgtgttgacacagtctccagccaccctgtctttgtctccgaggggacagagccaccctctcctgcagggccagtcagagtaattaacaactgcgcagcctggtgccaaacaaaaacctggccaggctcccaggctcctcatctttgatcgcctccaaagtacgggtccctggccgtcccagccaggttcagtggcagtgggtctgggacagtactcactctcaccatcagcagccgtgggacgtccgtagaaagttagtttttgggtagttttaattactggttaccaaggtaaccgttgacctaacgtggttaactacgttttcggaccgtagggggtaaccaaggtccgtagggaatacgtacgaaggccgaacgttggtacgggctcggaccaacccgtattcttcggttacctttacgaactttcccgttccccgactaacg

SEQ ID NO: 107144 - DNA, 577 bp, Homo sapiens
  misc_feature: GYAE6OF02F0CYE.23.86.H09.1.454.CMB.1.raw
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatagggtccctggccgtcccagccaggttcagtggcaggtgggtctgggacagacttcactctcacatcagcagcctggacncctgaagtntttggtntttatactgttacagtaaccgttgactaacgttggtaacctacgttttcgggacccgtagggggtaacccaaggtccgttagggaagtacgttacgaagccggtaagtcggtacgggtctggacctaaccgtattccgttgttccttcactttcccgttccccgaccttacg

SEQ ID NO: 107145 - DNA, 587 bp, Homo sapiens
  misc_feature: GYAE6OF02JAI2J.23.86.H09.1.454.CMB.1.raw
  modified_base (398)..(398): a, c, t, g, unknown or other
  misc_feature (398)..(398): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaaacaaaaacctggccaggctccaggctcctcatctttgatgcctccaatacgggtccctggccgtcccagccaggttcagtggcagtggtctgggacagcttcactctcaccatcagcagcctggacgcctagaagtnttttgggtgtttaattacgtgtacaaggtaaccgttgactaacgttggtacctacgttttagggacccgtaggggaccaaggtccgtagggaacgtatacgaagtccgaacgttggtacggcgttacgacctaacccgtagttccgttacggttcctttaccgactttcccgtttcccccggacctacg

SEQ ID NO: 107146 - DNA, 521 bp, Homo sapiens
  misc_feature: GYAE6OF02INT1W.23.86.H09.1.454.CMB.1.raw
  modified_base (388)..(388): a, c, t, g, unknown or other
  misc_feature (388)..(388): n is a, c, g, or t
  modified_base (498)..(498): a, c, t, g, unknown or other
  misc_feature (498)..(498): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatagggtccctggcgtcccagccaggttcagtggcagtgggtctgggacagacttcactctcaccatcagcagcctggacncctgaagtattttggtgtttattactgttcaagtaccgttgctaacgtggtactacgttttggcctaggggaccaagctgggatatcgaagcgactggtggctcgcaccntctgtcttcatccttcccgctac

SEQ ID NO: 107147 - DNA, 605 bp, Homo sapiens
  misc_feature: GYAE6OF02IC2MT.23.86.H09.1.454.CMB.1.raw
  modified_base (248)..(248): a, c, t, g, unknown or other
  misc_feature (248)..(248): n is a, c, g, or t
  modified_base (389)..(389): a, c, t, g, unknown or other
  misc_feature (389)..(389): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgnagcctggtgccaaacaaaaacctggccaggctcccaggcctcctcattctttgatcgcctcaatcggtccctggcgtcccagccaggttcagtgcagtggtctgggacagacttcgactctcacatcagcacgcctggacnccgtagaagttagttttcgggtgtttaattacgtagttccaagtacccgttgcctaaacgtgtaacttacgttttggacccgtaaggggtacccaaggtccgttagggaagtacgtacgaaacggcgtaaaccgttggtacgggtccttacggcctaaacccgtagttccgttacgttcctttaccgtaacgtttccccttccccggaccttaacg

SEQ ID NO: 107148 - DNA, 688 bp, Homo sapiens
  misc_feature: GYAE6OF02JNENV.23.86.H09.1.454.CMB.1.raw
  modified_base (245)..(245): a, c, t, g, unknown or other
  misc_feature (245)..(245): n is a, c, g, or t
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccacctctcctgcagggccagtcagagtattaacactgcncagccttggcgaccaaacaaaaccgtggaccaggtccncgtaccgacgtcctctactattcttgactcgacctacgtaacgtcggtccgtcgtccgaccgacgtcgtacggttacgnggtacggacggttaggtcgggtacgtacggactacgtaccttcgtacctccactaccgtagtaccgacgaccgtacgtaccggtacggacgttaacggtaggttaaggtttcggtttttacggtttaacgtttacgttacgtacggttaccgtaaacggttaccgttacgtacgttaacgttaccggtttacgttcggttaccgggaaccggtaacggtaactaggtacgtaacggtaacgtacgaacgtacgtacgtagttacggacgtacacgtacctacgttacgttcttacggttccttacgtaccgttcccgtaccttacg

SEQ ID NO: 107149 - DNA, 524 bp, Homo sapiens
  misc_feature: GYAE6OF02F6YLY.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggaccaggctcccaggctcctcatctttgatgcctcaatagggtcccctggccgtcccagccaggttcagtggcagtggtctgggacagacttcactctcaccatcagcacgcctggagcctagaagtagttttggtgtttattactgtcaagtacgttgacaactggtactacttttggcctaggggaccaagcgtaggagactcgaagcgactgtggctgccacctatctgttcttcactccttcccgctac

SEQ ID NO: 107150 - DNA, 600 bp, Homo sapiens
  misc_feature: GYAE6OF02IGXMJ.23.86.H09.1.454.CMB.1.raw
  modified_base (295)..(295): a, c, t, g, unknown or other
  misc_feature (295)..(295): n is a, c, g, or t
  modified_base (332)..(332): a, c, t, g, unknown or other
  misc_feature (332)..(332): n is a, c, g, or t
tcagacgcgagtatcacgaccggtgctcgatttagtgctatagacttgggtttgggggaggaactgttcagtcaggacccagagggaaccatggaagccccagctcagcttctcttctcctgctactctggctcccagataccaccggagaaattgtgttgacacagtctccagccaccctgtctttgtctccaggggacagagcccaccctctcctgcagggccagtcagagtattaacaactgcgcagcctggtgaccaaacaaaaacctggaccaggcctcccaggctcctnatctttgatcgcctccaatacgggtccctggctcccngccaggttcagtggcaggtggtctgggacagacttcactctcaacctatccagcagcctggacgccgtgaagtgttttggttagtttattactgtactacggttaaccgttgacgtaaccgttgggtaactacgttttcgggaccgtaacggggtaacccaaggtcgtagggaagtactacgaacggacgtaacgttggtcggcgtacggacctaacctagttccgtgttccttactaaccgttcccgttccccgtaccgtattaccg

SEQ ID NO: 107151 - DNA, 637 bp, Homo sapiens
  misc_feature: GYAE6OF02HAM1V.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtcttttgtctccgaggggacagagcccaccctctcctgcagggccagtcagagtattaacaactgcgcagcctggtgccaaacaaaaacctggaccaggcctcccaggctcctcatctttgatcgcctccaagtcgggtccctggccgtcccagcctaggttcaggtggcagtgggtctgggacagtacttcactctcaccatcagcagcctggacgtccctaggaaacgttgtttttgggtagttttaagtttacgtgttacgtaacgtaaccgtttgaacctaacgttgggttaaccttacgtttttacgggacccgtaagggggtaaccctaaggtccgttagggaagacttacgaacggaccgtaacgtggtacggcttacggacctaacccgtaagttccgttacggttcctttaccgacgtttacccgtttacccccgaccttaaccg

SEQ ID NO: 107152 - DNA, 576 bp, Homo sapiens
  misc_feature: GYAE6OF02IGB42.23.86.H09.1.454.CMB.1.raw
  modified_base (248)..(248): a, c, t, g, unknown or other
  misc_feature (248)..(248): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (499)..(499): a, c, t, g, unknown or other
  misc_feature (499)..(499): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgnagcctggtgaccaaacaaaaacctggccaggcctcccaggctcctcattctttgatcgccttccaatcgggtccctggccgtcccagccaggttcaggtcggcaggtgggtctgggacagacttcacgtctacaccatcagcacgcctggacnccgtagaagttnttttgggtatttaagttcgtgtactaagtaaccgttgacctaacgtgtactacgtttcggaccgtaggggaccaaggcgtaggganaacgtcgaacggcgtaacgtggtcggtctggacctaccgtattccgttgtaccttccacgttcccttcccgctaacg

SEQ ID NO: 107153 - DNA, 555 bp, Homo sapiens
  misc_feature: GYAE6OF02IE3EL.23.86.H09.1.454.CMB.1.raw
  modified_base (382)..(382): a, c, t, g, unknown or other
  misc_feature (382)..(382): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgaccaaacaaaaacccgtggacccaggcctcccgaggcctcctcattctttgatcgcctaccaagtacgggtccctgggccgtcccgagcctagggttccaggtcggcaggtcgggtcgtgggacngtacttcactctcacatcagcagcctggacgctagaagtnttttggtntttattctgtactagtaccgttgactaacgtgtactagtttcggccgaggggaccagcgtagacgatacgaagcgaacgttggcgctcgccacgtatcgttcgtcttccacttccctcccgctac

SEQ ID NO: 107154 - DNA, 750 bp, Homo sapiens
  misc_feature: GYAE6OF02IOHM1.23.86.H09.1.454.CMB.1.raw
tcagacgcgagtatcacgaccggtgctcgatttagtgctatagacttggggtttgggggaggaactgctcagtcaggacccagagggaaccatggaagccccagctcagcttctcttcctcctgctactctggctcccagataccaccggagaaattgtgttgacacagtctccagcccaccctgtctttgtcctccgaggggacagagcccaccctctcctgcagggccagtcagagtattaacaactgcgcagcctggtcgaccaaaacaaaaaccgtggaccaggcctccccgaggcctcctcacttctttgactcgtccctaccgaaagtacgggttcccctagggtccgtccccaaggtccctagggtttaccagggttcggcgtagggttcgggttcgtacggggaacgtacgtaccgtttccaaccgttcctaaccaacccgtaagtccaacgggcctaacggcccgtaggggaacctccgtaggtaaacggtttagttttttaggggtactttttaaacgttacgttacgggtaccgttaaacggttaacccgggttttcaaccgttaaacggttcggttaaacccttacgggtttttacggggacccggtaacgggggggtaaacccaagggttccgtagggtaacggtaaacgtacggaaacggtacgaacgttggtaccggactggaccctaacacgttcgtcgttaccgtttagccttaccgtttccccgagttaacg

SEQ ID NO: 107155 - DNA, 524 bp, Homo sapiens
  misc_feature: GYAE6OF02GTI90.23.86.H09.1.454.CMB.1.raw
  modified_base (396)..(396): a, c, t, g, unknown or other
  misc_feature (396)..(396): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaacctggccaggctccaggctcctcatctttgatgcctccaatacgggtccctggcgtcccagccaggttcagtggcagtgggtctgggacagacttcactctcaccatcagcagcctggacgcctgaagtntttggtgtttattactgtcagtacgttgcaactggtactcgtttcggaccgtaggggaccaaggcgtaggagtatacgaagcgtacgtgtggtctagccaccatcgtgttctctactcctcccgctac

SEQ ID NO: 107156 - DNA, 766 bp, Homo sapiens
  misc_feature: GYAE6OF02JU04P.23.86.H09.1.454.CMB.1.raw
tcagacgcgagtatcacgaccggtgctcgatttagtgctatagacttgggtttgggggtagggaacgtggctcagtcaggacccagagggaaccatggaagccccagctcagcttctcttcctcctgctactctggctcccagataccaccggagaaattgtgttgacacagtctccagccaccctgtcctttgtctccaggggacagagccacctctcctgcagggccagtcagtagtattaacaactgcgcagccttggtcgccaaacaaaaacctcggaccaacggcctaccccagggacctccctcgactcctttagattcgtccctacaacgttacgggtccccgtgggcccgttccccaacggtcccgaagggtttcccaaggttcgggccgtaaggttcggggtccgtagggggaccacggtaactttccgaccgttctacccaacctataccaggtccaaccggtcctcgggaactccgtaaggaacggttagttttcgggttacgttttaactttaaccgttgttacgttaacgtaacccggtttaggtacctaaacgttcggttaaccgttaccggtttttaccgggaccgtaacgggggtaccctaaagggttccgttaagggtacgtaaacgtttcgaaacgggtacccgtaaacgggttcggtacgggtccgttaacgggacccctaacgttaaccgttccttaacgggtttcctttaccgtacgtttaccccgttttccccgacgttaaccg

SEQ ID NO: 107157 - DNA, 529 bp, Homo sapiens
  misc_feature: GYAE6OF02IP587.23.86.H09.1.454.CMB.1.raw
  modified_base (407)..(407): a, c, t, g, unknown or other
  misc_feature (407)..(407): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaaacaaaaacctggccaggcctcccgaggctcctcattctttgatgcctccaatcgggtccctggctccagccaggttcagtgcagtggtctgggacagacttcactctcaccatcagcagcctggacgcctagaagtattttgggtntttattactgtcagtaccgttgacaacgtggtactagttttcggacctaggggacctaaggctagggagatacgaagcgactgtggcttgctaccatctgttcttccattccttcccgctac

SEQ ID NO: 107158 - DNA, 612 bp, Homo sapiens
  misc_feature: GYAE6OF02G05H3.23.86.H09.1.454.CMB.1.raw
  modified_base (404)..(404): a, c, t, g, unknown or other
  misc_feature (404)..(404): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgcccaccctctcctgcagggccagtcagagtattaacaactgcgcagcctggtcgaccaaacaaaaacctggaccaggcctcccaggcctcctcattcttgactcgcctcaagtacgggtccctggccgtcccacgccgtaggttcgaggtggcgtaggtgggtcgtgggacagtacttcactctaccaccatcagcncgtccgtggacgtccgtagaaggtttagttttaggttagtttaacgttacgtgtacgtaacggtaaccgttgactaacgtcggttaccttacgtttcgggaccgtaggggaacctaaggtcgtaggaagtctaacgaagacgtagttggtacggcgtcgactaccgtattccgttcgttccttactacgttcccgttccgtacctacg

SEQ ID NO: 107159 - DNA, 950 bp, Homo sapiens
  misc_feature: GYAE6OF02H0IHT.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccaccctctcctgcagggccagtcagacgtaattaaacaactgacgcagcctggtcgacccaaacaaaaaaccgtggaccaagggcctaccccgaagggcctccctactaacttcttttcggaactcgacccttacctaaaacgttcgggttcccctgggtcccgttccccaacggccctaagggtttccgaagggtcgggtaccgtaagggttcggggtaccgttacggggggaactacgggttaaccgttaccaaccgttcccttaccgaaccctaacttaccgaacgtaccgacggtacccggttagggaccgtcccgttaaggtaaacggttaagttttttcgggtaacgtttttaacgttaacgtttggtaaccgttaaacgggttaaacccgttgtaacccgttaaacgtttcgggttaaaccctttaccgggttttttaccgggggaacccgtaaaccgggggggttaaacccctaaaggggtacccggtttaagggggtaaaacccggtacgggtttaaaaaccccgtaacgggggttaacccgggtaaaaccgtttttacgggggggttacccgggtaaacccggttttacccgggggaaccccctaaaccccgggttttaaacgtttcccccggggtttttaaccggttttaccccggtttttaaacccgtaaaccccgggttttttacccccggttttaaccccccccgggtacccgtttttaaaacccggg

SEQ ID NO: 107160 - DNA, 628 bp, Homo sapiens
  misc_feature: GYAE6OF02HKYWO.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcttcctgctactctggctcccagataccaccggagaaattgtgttgacacagtctccagccaccctgtctttgtctccaggggacagacgccaccctctcctgcagggccagtcagagtattaacaactgcgcagcctggtcgaccaaacaaaaacctggaccaggcctccaggcctcctcattctttgatcgcctacaagtacggtccctggccgtcccagccgtaggttccaaggtcggcgaggtcgggtctgggacaggtacttcgacttctacctaccagtcaacgcgacgtccgtaggacgccgtagtaagttagttttggttatttaacgttacttggttacgtaacggtaacccgtttggacctaaacgttcggttaactacgtttttcgggaccgtagggggtaccctaaaggtccgtaggaacgtattacgaaacggtcgtaacgtggtacggctacgacctacgtaatcgttacgtcgttacacttccgttccccgctaacg

SEQ ID NO: 107161 - DNA, 673 bp, Homo sapiens
  misc_feature: GYAE6OF02IMARR.23.86.H09.1.454.CMB.1.raw
  modified_base (250)..(250): a, c, t, g, unknown or other
  misc_feature (250)..(250): n is a, c, g, or t
tcagacgcgagtatcacgaccggtgctcgatttagtgctatagacttggggtttggggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgnagcctggtgaccaaaacaaaaaccgtggaccaggcctcccgaggcctcctctacttctttgactcgcctacaagttacggtccctggcctccgagtccgtaggttcaggtcggcgtaggtcgggtcgtgggacagtaccttcacgtctaccaacctatcgagccgacgtaccgtggacgtccgtaggtaacgttagtttttgggttacgttttaacgttacgttggttaacctaacggttaaccgtttgaaccttaacgttcgggtaaccttacggttttcgggaccggtaacgggacctaagtccggtaggaagtactacgaaacgcgtaacgttggtacggtctaccggtacctaacccgttacgttccggttacgtttaccctttacgtacccgtttaccccgttccccgacgttaaccg

SEQ ID NO: 107162 - DNA, 641 bp, Homo sapiens
  misc_feature: GYAE6OF02GYPS3.23.86.H09.1.454.CMB.1.raw
  modified_base (633)..(633): a, c, t, g, unknown or other
  misc_feature (633)..(633): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagacgcccaccctctcctgcagggccagtcagagtattaacactgcgcagcctggtgaccaacaaaacctggccaggcctcccaggctcctcattcttgatcgcctaccaagttacgggtccctggccgtcccacgtccaggttcagtggcaggtgggtctgggacagtacttcactctccacctatccagcacgcctgggacgtccctaggtaaacgtgtttttcgggtagttttacttaccgttgttactaacggtaaccgtttgaccgtaacgttcggtaaccttacgttttacgggacccggtacgggggtaaccctaacggtccggtaagggaacgtagtaaccgaacggtaccgtaacgtcgggtacggtcgtcgaccgtacctacgttccgttagttaccttactacctttcccgttcccccggnttaacccg

SEQ ID NO: 107163 - DNA, 682 bp, Homo sapiens
  misc_feature: GYAE6OF02GQYEN.23.86.H09.1.454.CMB.1.raw
  modified_base (496)..(496): a, c, t, g, unknown or other
  misc_feature (496)..(496): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaattgtgttgacacagtctccagccaccctgtctttgtctccaggggacagacgccaccctctcctgcagggccagtcagagtattaacaactgcgcagcctggtcgaccaaaccaaaaacctggaccacggcctcccgacggcctcctcacttctttgactcgcctccaagtacgggtccctggccgtcccacgcctaggttcaggtggctaggtgggtcgtgggacagtacttcactctaccacacgtcacgcgacgcccgtacgggacgtacccgtaggtaacgttaggtttttcgggttagttttaacttacgttcggttaccgtaaggtaacccggtttnaaccgtaacgttcggttaaccttacgttttaccgggaccgtaacgggggtaaccagggtaccgttagggaagtaacgttacgaaacggtccgtaagttcggttacggtccgttacgaccggtaacctacggttcccttaggttccctttaccgtaccgtttcccgtttaccccggtaccctaaccg

SEQ ID NO: 107164 - DNA, 675 bp, Homo sapiens
  misc_feature: GYAE6OF02HG4A8.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagcccaccctgtctttgtctccaggggacagacgccaccctctcctgcagggccagtcagagtattaacactgcgcagcctggtcgaccaaacaaaaacctggaccaaggcctccccaggcctccctcacttctttagatcgccctaccaagttacgggtcccctggcccgtcccacgtccgtacggttcaggtcggcgaggttcgggtcgtgggacagtcttctactctaccgaccataccgagcacggtccgtacgggacgtaccgttaggaagtttagttttgggttacgttttaacttacgttcgtacgtaacgtaccgtttcgaaccgttaacgttacggtaccttacggttttccgggaccggtaacggggtacctaaggtccgtaggtaacgtactaacggaacgtaccgtacgttggtacggtcgtacgacctaccgtacgttccgtttacggttcccttacgttaccgtttccccgttacccgaccttaaccg

SEQ ID NO: 107165 - DNA, 631 bp, Homo sapiens
  misc_feature: GYAE6OF02GXHCP.23.86.H09.1.454.CMB.1.raw
  modified_base (414)..(414): a, c, t, g, unknown or other
  misc_feature (414)..(414): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagcccaccctctcctgcagggccagtcagagtattaacaactgcgcagcctggtgaccaaacaaaaacctggaccaggcctcccgaggcctcctcattctttgatcgcctaccaagtacgggtccctggcctcccgagccgtaggttcaggtcggcaggttcgggtcgtgggacagtacttcactctacaccatcagcacgccgtgggacnccgtagaacgttagtttttgggttacgtttatttacgtggttccgtaacggtaaccgtttagacctaaacgttcggtaaccttacgtttgggacccgtaggggtacccaaggtcgtaggacgtacgttaacgaacggtacgtacgttggtcgggtctacggacctaccgtattccgtcgtttccttaccgtacgttccccgtttacccgacttaacg

SEQ ID NO: 107166 - DNA, 571 bp, Homo sapiens
  misc_feature: GYAE6OF02FIYML.23.86.H09.1.454.CMB.1.raw
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (528)..(528): a, c, t, g, unknown or other
  misc_feature (528)..(528): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggcctccccaggcctcctcatcctttgactcgcctccaagtcgggtcccctgggccgtcccagcccaggttcagtggcagtgggtctgggacaggacttcactctcaccntcagcagctggacncctgaagttagtttggtatttattctagttcagtaaccgttgactacgttggtacttacggttttcgacgtaggggaccaaggtcgtagagattacgaagtacgacgtggtaggtcctgacccaccgtnttacgtcggttaccttacctcgttcccgttcccgaccttaacg

SEQ ID NO: 107167 - DNA, 582 bp, Homo sapiens
  misc_feature: GYAE6OF02H3JJF.23.86.H09.1.454.CMB.1.raw
  modified_base (410)..(410): a, c, t, g, unknown or other
  misc_feature (410)..(410): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtcctccagccaccctgtctttgtctccaggggacagagccaccctctcctgcagggccagtcagagtattaacaactgcgcagcctggtgcccaacaaaaacctggccaggcctcccaggctcctcatcttgatgcctccaagtacgggtccctgggccgttcccacgcccgtaggttcaggtcggcgtaggttcggggtctggggacaggtacttcactctcaccatcagcagcctggacncctagagtagtttggttactttagttactgttacaacgtacgttgacgtaactcggtacttacgttttcggaccgtaggggaaccaaggtccgtggaacgactacgaagacgtaacgtggtacggcttcgcaccgtattccgttgttctcctacttcccttcccgtactacg

SEQ ID NO: 107168 - DNA, 623 bp, Homo sapiens
  misc_feature: GYAE6OF02IHBPU.23.86.H09.1.454.CMB.1.raw
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccagggacagagccacctctcctgcagggccagtcagagtattaacaactgcgcagcctggtgaccaaacaaaaacctggaccaggcctcccaggcctcctcattctttgatcgcctccaatacgggtccctggccgtcccagccaggttcagtcggcgtagtcgggtctagggacagtacttcacttctacaccactcagcagccgtggacncgtagaacgttattttggtntttattacgttgtctaagtaaccgttgaaccgtaactggtaacctcgttttcgggacccgtaggggtaacccaaggtcgtagggtaacgacgtacgaacgtacgtaacgttggtaacggccttcggaccctaacccgttatttacccgttacgtttccctttaccgttaccgtttccccgttaccccccgacttaccg

SEQ ID NO: 107169 - DNA, 612 bp, Homo sapiens
  misc_feature: GYAE6OF02JJ0QA.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatcttgatgcctcaatacgggtcctgcgtccagccaggttcaggtggctaggtggggtctggggacacgacttcacttctccgacactcgacgcacgccgtggagtccgtaggaagtagtttttgggtcgtttaattcgttaggttaccgacggttaacccgtttggacctaaacgtttcgggtaaccttacggttttcgggacccgtaggggtaacccaaaggtcgtagggagtactacgtaacggccgtaattggcgggtactcggtacctaccgtaattccgtcggttccttacgtactcccgttcccgcccttaacg

SEQ ID NO: 107170 - DNA, 569 bp, Homo sapiens
  misc_feature: GYAE6OF02G6132.23.86.H09.1.454.CMB.1.raw
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (454)..(454): a, c, t, g, unknown or other
  misc_feature (454)..(454): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtcctccgaggggacagagcccaccctctcctgcagggccagtcagagtattaacaactgcgcagcctggcaccaaacaaaaccgngaccacgccnccgagcctcctcnttcttgatcgccctacgaagtccgggtcctggcctccgagccgtaggtcaggtcggacgtggtgggtcgtagggacacgtaccttcactcncacataccngacncgcgtggacncgtagtaacgttgtttggtatttactctgtacctaagtccgtnactacgtcgtacttcgttcgggaccgtagggacctaggtcgtaggactacgacgaagccgtagtggtcgtcgtactcacgtagttcgtctttctacctccttccctccgtatccg

SEQ ID NO: 107171 - DNA, 521 bp, Homo sapiens
  misc_feature: GYAE6OF02HXSZX.23.86.H09.1.454.CMB.1.raw
  modified_base (246)..(246): a, c, t, g, unknown or other
  misc_feature (246)..(246): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
  modified_base (517)..(517): a, c, t, g, unknown or other
  misc_feature (517)..(517): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgctccaggggacagagccacctctcctgcagggccagtcagagtattaacaactgcgnagcctggtgaccaaacaaaaaacctggaccaaggcctacccaaggctcctcattctttgatcgcctaccaagtacggtccctggctcccagcctaggtcagtgcagtggtctgggacagacttcactctcacatcagcagctgganctagacgtatttggtnttaatactgtcaagtacgtgactaacgtgtaactagtttgaccgagggaccaaggctagganatcaagcaagtgtcgntcgacactatcgngttctacgatccttccgntacg

SEQ ID NO: 107172 - DNA, 657 bp, Homo sapiens
  misc_feature: GYAE6OF02H7SBY.23.86.H09.1.454.CMB.1.raw
  modified_base (244)..(244): a, c, t, g, unknown or other
  misc_feature (244)..(244): n is a, c, g, or t
  modified_base (610)..(610): a, c, t, g, unknown or other
  misc_feature (610)..(610): n is a, c, g, or t
tcagacgcgagtatcacgaccggtgctcgatttagtgctatagacttgggcttgggggaggaactgctcagtcaggacccagagggaaccatggaagccccagctcagcttctcttcctcctgctactctggctcccagataccaccggagaaattgtgttgacacagtctccagccaccctgtcttgtctccagggacagagccacctctctgcagggccagtcagagtattaacaactgcangcctggtcaccaaacaaaaaccgtgccaggctcccgaaggcctctcgactctttcgattcgcctaccaacgtcggtcccgtggccgtcccagcccgtaaggttccagttcggcgacggttcggtacgtagggacgtaacgtacgtttccaacgttccctacgaccacgtcacgcaacgtcgtacggtaacgccctaggtaacgttacgttttgggtaagttttacgttattaccggtactaacgttaaccgttggaccgttaaactcgggttaacctttaaccggttttccggaaccggacggggaaccttaaggccgtttaagggatacggttacaacgaccgtaaacggtggtaagtccggtanacctacccgattccgtagttccttacgtacttcccgtaaccgtcccg

SEQ ID NO: 107173 - DNA, 621 bp, Homo sapiens
  misc_feature: GYAE6OF02GS1VZ.23.86.H09.1.454.CMB.1.raw
  modified_base (483)..(483): a, c, t, g, unknown or other
  misc_feature (483)..(483): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagagccaccctctcctgcagggccagtcagagtattaacaactgcgcagcctggtcgaccaaacaaaaccgtggaccaggcctcccgagcctcctctacttctttagactcgccctacaacgttacgggtccctggcccgtccacgtccgtacggtcgaggtcgcgaggtgggtcgtaggactaggtcttcgactcctcaccgtatcgacgcgacgccgtaggactccgtagtaaacgttgttttacggtatttacgtacgtagtacgtaacgtaccgttnacgttactcggtactacgtttcggaccgtacgggactaggtcgtaggacgtacgtaacgagtaccgtacgtcggtcggtactcggacctaacgtagttccgttcgttccttacctaactcccgttcccgacttaaccg

SEQ ID NO: 107174 - DNA, 632 bp, Homo sapiens
  misc_feature: GYAE6OF02IX4LI.23.86.H09.1.454.CMB.1.raw
  modified_base (166)..(166): a, c, t, g, unknown or other
  misc_feature (166)..(166): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacanagtctccagccaccctgtctttgtctaccgagggacagacgccaccctctcctgcacgggcagtcagagtacttaacaactgcgcagcctggtgaccaaacaaaaacctggaccaggcctccaggctcctctatctttagatcgcctacaagtaggtccctggccgtacccagcctacggttcacgtggcaggtcgggtacgtcgggacagtaccttcgacttctacaccatccgagacacggtctcggactaccgtgaagttcgttttgtacgtttacttacgtgtaactacggttaaacgttcgactaacgtacggtactacgttttcggaccggtacgggactaacggtccgtaggaacgtacgtaaccgaacgtacgtagttcggtacggtcgtacgacctaaccgttccttacgttaccgttaccttaccgtaccttacccgttacccggtacccttaacg

SEQ ID NO: 107175 - DNA, 549 bp, Homo sapiens
  misc_feature: GYAE6OF02FNCRQ.23.86.H09.1.454.CMB.1.raw
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaactggccaggctcccaggctcctcatctttgatgcctcaatacgggtccctggcgtcccagccaggttcagtggcaggtgggtcgtgggacagtacttcactcncacatcagcagcctggcnctgaagtatttggtntttattctgtcagtaccgttgacaacttgtactacgttttgaccgtagggtaccaagtcgtggagtagtacaagcgtaacgtgtacggtctagccgtaacctagttacgtcgttccttacctacgttcctttccccggacttaccg

SEQ ID NO: 107176 - DNA, 647 bp, Homo sapiens
  misc_feature: GYAE6OF02I0LN2.23.86.H09.1.454.CMB.1.raw
  modified_base (448)..(448): a, c, t, g, unknown or other
  misc_feature (448)..(448): n is a, c, g, or t
  modified_base (496)..(496): a, c, t, g, unknown or other
  misc_feature (496)..(496): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccaccctctcctgcgagggccagtcagagtaattaacaactgacgcagcctggtcgaccaaacaaaaacctggaccaggcctcccgaggcctcctacattcgtttgactcgccctaccgaagttaccgggtcccgtcgggcccgtccccgacggtcccgtagggttcacggtcgggcctagggttcgggtcgtagggactacggtaccttcactctcaccatccgagcacgccgtaggacncctagaagttagttttcgggtatttattacgtgtactaggtaccgttnacctaacgttggtaacctttacgtttcggacccggtacggggtaccaaggtcgaggtaacgtactaacgacgtacgtagtcggtacggcgtacgaccgtaacctacttccgtcggttaccttccgtacccttcccgttaccccgtctaccg

SEQ ID NO: 107177 - DNA, 857 bp, Homo sapiens
  misc_feature: GYAE6OF02HOJS3.23.86.H09.1.454.CMB.1.raw
  modified_base (221)..(221): a, c, t, g, unknown or other
  misc_feature (221)..(221): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtcccacggaggacagaccacccacctcctccncgacggacggactacgtacgagtaagttaactaaacacgtcgaccgacgaccgtcgtgccgaaccaaaactaaaccgtcgacgacgtacccacgacgtcctcactactttcgtacacgtccgtaccctaacgtaaacgggttccggtaccggtcggtaccctaccgacgtaccggtacgtacgtacgggtcgtaggtacgggtcggtacgggtacggaacgtacgttaccttacgtaccttaccgaccgtaaccttacgaccgaacgccggtaaccggtcggtacgggaaccttacggtaaaggtaacgttttgggttttacgtttacggttttaactaccgggtacgttaacgaaaccggttttaccggtaccgttaaaccgtacgggtttaccgttaaaccgttttaccgggtttacccgggaaccggggtaacccggggtaaactaacggggttcggtaaaccgggtaacgttaaaccggtaaacggtaaacccgggtacggtaacccggttttggggtaaccccgggttagaccccgggttaaactaacccggtttaccttaccggttttacccgtttaacccgttaccgtttaaccgtttttaaccgttttaccgaccggttttaaaccgg

SEQ ID NO: 107178 - DNA, 738 bp, Homo sapiens
  misc_feature: GYAE6OF02H1VR0.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagaaattgtgttgacacagtctccagccacccttgtctttgtctccgaggggacagacgcccaccctctcctgccgagggccagtcagagtaattaaacaactgcgcacgcctggtcgaccaaaccaaaaaaccgtcggaccacggcctacccgacggccttcctctacttcttgactcgcctaccgtaacgttacgggtcccgtcggtccgtacccgacgtcccgtagggttccaggtcggacgtaggttcggggtcgtaggggaactaacgtaccttcaaccttcctaccaacctacgtacagtaccacggtacccgtacgggacgtacccgttaaggtaacggtttaggttttcgggttttagtttaacgttaccgttagtaccgtaaacgttaaccggtttcgacgttaaacgtcggttaaccgttacgttttaccgggaccggtaacgggggtaaccaagggtaccggttaggaacgtaagtaaccgaaagggttaccgtacggttggtacgggtctaccggacctaaccgtacgttacgtttcggttccttacgttacctttaccccgttcccgtacctacg

SEQ ID NO: 107179 - DNA, 780 bp, Homo sapiens
  misc_feature: GYAE6OF02IG4JR.23.86.H09.1.454.CMB.1.raw
tcagacgcgagtatcacgaccggtgctcgatttagtgctatagacttgggtttgggggagaactgctcagtcaggacccagagggaaccatggaagccccagctcagcttctcttcctcctgctactctggctccagactaccaccggagaaattgtgttgacacagtctccagcccacctgttctttgtctccgaggggacagacgccacccgtctcctgcgagggccacgtcagtagttaacttaaccaactcgcgcagccgtggtcgaaccaaaacaaaaaccgtcggacccgaggcctccgaggtcctctacatttcttgactcgaccttacgaagttaccgggtccctggccctccgacgtcccgtaggttaccgtaggtcggctagggttcgggtcgacggggtaactacggtaccctttacgaaccttccgtaccaacctacgctacggccacggtaccgtacgggtaactccggttaaggtaaagttttcggttttttacggagttttaaccgtttacgtagttaacccgaaacgggttttacccgtaggtaaccgttaaacgggttcggttaaacccgtttacgggttttacccgggaaccgggtaaacggggtaaccctaagggttccgttaacggggtaattacgaaaccgtaacgggtacgttaacgggttcggtacgggtaccgtaaccggcctaaacccgttacttaccgggtttctttaccccggtttactaccccggtttacccgttccccgtaaccgttaccc

SEQ ID NO: 107180 - DNA, 667 bp, Homo sapiens
  misc_feature: GYAE6OF02G5MUD.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagcccaccctctcctgcagggccagtcagagtattaacaactgcgcagtcctggtcgaccaaacaaaaacctggacccaggcctcccaggtcctccgtcattctttgatcgcctcaagtacgggtccctggccgtacccacgtccgtacggttcaacggttcggcgtacggttggggtcgtcggggaacacggtacttacgacttcctaccgtaaccagtacacggactaacgccctagggacgtaccctagggtaaagtttacgtttttgggtagttttaactttacgtcgttaacacggtaaccgtttgacctaacgtggttacctacgtttaggacccgtaaggggacctaaggcgttagggaacgtaactacgaacgtccgtaacgtggtacggcctcggtaccaaccgttattccgttacgttcccgttactaccgtttacccgttccccgacgttacc

SEQ ID NO: 107181 - DNA, 862 bp, Homo sapiens
  misc_feature: GYAE6OF02J3NPR.23.86.H09.1.454.CMB.1.raw
tcagacgcgagtatcacgaccggtgctcgatttagtgctatagacttgggtttgggggagaactgctcagtcaggacccaggagggaaccatggaacgcccagctcagcttctcttcctctgctactctcggctacccagactaccgaccggtataaacttgtgttacgacacacgtcctaccacgccctacccttgttctttgcctccggaggggacacgaccgtccctacccgtctaccgtggaccgacgggcctaggtaccaaggtactaacttaacacgtcggcgaccgagtcccgtaggtaccgaacctaaaccgaaaaccgtcgggacctaacggtcccctacccgtacggtcccttaccgtacttaacgttccgtttagaccgttccgtacctaaccgtaacggttccggtcccgtcgggtccctcccgacggtaccgtacggttaccgacggtcggtacgtcggttcggtacggtcggtaactacgtacctaccgtaccgtaccgtaccaccgtacgtaccgacgtcgtaacggtccggtaacggtaccgttaccggttaagtttaacggttttcgtttaacggtttacgtttacctaacggttaccgtaccgttaacggttacccggtttagtaaccggttaaccgtttacgttaccggtttaaccggttaccgggaacccgggttaacgggtaaccgtaacgtcggtaaccgggtaaactacggtaaccgaacgtaccggttaggtccggttaccggtaacgttaccggaacccgttaaccttccgttaacggttttcccgttaccgttaccccgtaaccgttttccccggacccgttaccgtttaacccgg

SEQ ID NO: 107182 - DNA, 673 bp, Homo sapiens
  misc_feature: GYAE6OF02HY063.23.86.H09.1.454.CMB.1.raw
  modified_base (351)..(351): a, c, t, g, unknown or other
  misc_feature (351)..(351): n is a, c, g, or t
  modified_base (454)..(454): a, c, t, g, unknown or other
  misc_feature (454)..(454): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacagacgccaccctctcctgcagggccagtcagataacttaacaacgtgcgcacgcctggtcgaccaaaactaaaaaccgtggaccgaaggcctccccgaggtcctaccgtcacttcgtttgatcgtccctaacgtaagtaccgggttccnggtccgtccccgagtccgtaggttcaggtcggacgtaggtcgggtcgtacggggactacgtacttcgaaccttccgtacacccgatccgagaccacgtaccgnggaccgtccgttagaaacgtttgttttcggtatttaactcgtcgtataacgtaacgttcgaactaacgttcgtacttacggtttcggaaccggtagggaacctaggtccgtaaggacgtagtaaccgaggtaaccgtagtcggtcggtacgcgttaaccacccgttacgttacgttccgttacgttaccgttaccttcccgtttaccccggatttaccg

SEQ ID NO: 107183 - DNA, 692 bp, Homo sapiens
  misc_feature: GYAE6OF02JYE59.23.86.H09.1.454.CMB.1.raw
  modified_base (247)..(247): a, c, t, g, unknown or other
  misc_feature (247)..(247): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacactgcgnagcctggtcgaccaaacaaaacctggaccacggctcccgaggtcctccgtacattctttgactcgcctacctaagtacggtccctcgggcccttcccgacgccgtaggttcaggttcgacgtacggttggggtccgtaggggacctaggtaccgtttacacgttcctaccgaaccgtacttacgacgtccgaacggtccgtacgggtacgccgttaaggaacgtttagttttcgggttaacgttttacgttacgttccggttaacgtaacggttaaccgttacgaccgttaacgttcggtaaccttcggttttaccgggaccggtaacggggtacaacggtccggtagtaacgtctaacgtaacggtacgtacgtggttacggctacgactccgttaagttccgttagttccttaccgtaccttcccgttacccgacgttaaccg

SEQ ID NO: 107184 - DNA, 799 bp, Homo sapiens
  misc_feature: GYAE6OF02F49HY.23.86.H09.1.454.CMB.1.raw
tcagacgcgagtatcacgaccggtgctcgatttagtgctatagacttgggtttggggggaggaactgctcagtcaggacccagagggaaccatggaagccccagctcagcttctcttcctcctgctactctggctcccagataccaccggagaaattgtgttgacacagtctccagcccaccctgtctttgtctccgaggggacagacgcccaccctctcctgcgacgggccagtcagagttataacacgtgcgcacgccgtggtcaccaaaaccaaaaccgtcgggaccgacggcctacccgaggccttcccgtctacttcgttttagattccgcccttaccgtaaacggttaccgggtccccgttacgggcccgtaccccacggtacccgtacgggtttaccgaggtcggcgtaggggtcgggttcggtacgggacctaggtaccttcaccttccgtactaccctaagttccgacgtaccgacgtcccggtaggtacccgtccgttaaggttaaaggtttaggtttttacgggtttacgttttaacgttaccgttacggttaccggtaaaccggtaccgtttacggaacccgttaggttccgtttaaccggtttaccggtttccgggaacccgggttaaccgggtaacccgtacggttaacggtcggggtaaacgtaccgttaacggaacggttaccgtaagggttccggtacggtaccgtacggtaaccctaccggttacttcccggtttacgtaccctttaccgtacccgtttccccgttacccgtacgttacgg

SEQ ID NO: 107185 - DNA, 727 bp, Homo sapiens
  misc_feature: GYAE6OF02H9KCP.23.86.H09.1.454.CMB.1.raw
tcagacgcgagtatcacgaccggtgctcgatttagtgctatagacttgggtttgggggagaactgctcagtcaggacccagagggaaccatggaagccccagctcagcttctcttcctcctgctactctggctcccagataccaccggagaaattgtgttgacacagtctccagccaccctgttctttgtctccaggggacagacgccaccctctcctgcagggccagtcagagttaattaaacaactgcgacacgccgtggtcgaccaaacgaaaaaaccgtcggaccaggcctacccgaggcctcctcgacttacttgactcgtcctaccaagttacggtccctacggccgtacccgagacccgtaggttccgaggtcggacgtaacggttcggggtacgtacggggacctaacggtaccctttcgtaacccttcgttaacccaacccgtaactcgaacggtacccgtacggacccgttacggggaccgtacccgttaaggtaaaggttacgtttttttggtacgttttaattacgttgtaaccgttaaggtacccgtttagaccgttaaacgttcgggtaaccttacggttttaccgggaccggtacgggtaacctaaggtcggtagaacggtactaacgaagtccgaagttggtacggtccgttagacccgtaccgtattccgttagttccgttacctaccgttcccgttaccccgacttacg

SEQ ID NO: 107186 - DNA, 637 bp, Homo sapiens
  misc_feature: GYAE6OF02II17P.23.86.H09.1.454.CMB.1.raw
  modified_base (253)..(253): a, c, t, g, unknown or other
  misc_feature (253)..(253): n is a, c, g, or t
  modified_base (384)..(384): a, c, t, g, unknown or other
  misc_feature (384)..(384): n is a, c, g, or t
tcagacgcgagtatcacgaccggtgctcgatttagtgctatagacttggggtttgggggaggaactgctcagtcaggacccagagggaaccatggaagccccagctcagcttctcttcctcctgctactctggctcccagataccaccggagaaattgtgttgacacagtctccagcccaccctgtcttttgtctccgaggggacagacgcccaccctctcctgcagggccagtcagagtattaacactgcgnacgcctggcgaccaaacaaaaccgtggaccaggcctccgaggcctcctcacttctttgatcgccttacgaagttccgggtccctggccgtcccagcccgtaggttacgaggtcggcgtaggtcggggtcgngggactaggtacttcactcctacacctatcagcacgtccgtgggactccgtagtaacgttagtttttggtagttttaacttacgtgttactaacggttaccgttcgactaacgttcggtaaccttacggtttcgggacggtaacggggaccaggtcgagggaatacgtacgaagaccggtacttgggtcgcgtaggccctaaccgtagtccgttcgtttaccttacgtaccgttcccgttccccgacttaccg

SEQ ID NO: 107187 - DNA, 716 bp, Homo sapiens
  misc_feature: GYAE6OF02I9HTT.23.86.H09.1.454.CMB.1.raw
  modified_base (203)..(203): a, c, t, g, unknown or other
  misc_feature (203)..(203): n is a, c, g, or t
  modified_base (708)..(708): a, c, t, g, unknown or other
  misc_feature (708)..(708): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccgaggggacngacgccaccctctcctgcacgggcagtcagagtaataaccactgcgcagcctggtcaccaaaccaaaaccgtcggccaacggcctccccgaggcctcctcattctttggactcgtcctaccaacgtacgggtccctggtccgtacccgagcccgtagggttccaggtcggacgtacgggtaccgggtcggtacggggtacctaaggtccctttacaccttccgtacctacctacgtccgacgaccgtacgtaccggtacggacgtaccgtaggtaaacgttgtttttacgggttacgtttacttacgtagttacccgtaagttacccggttacgaccgttaacgttcggtaaccctttcggtttacgggaccgtaacgggggtacccaagggtccgttaagggacttaccgacgtaacgtccggtaagttcggttaccgggtctacggacctaaccgtaaggttccctttagttccccgttaagttaccctacctttaccccggngttaaccc

SEQ ID NO: 107188 - DNA, 735 bp, Homo sapiens
  misc_feature: GYAE6OF02IXRKI.23.86.H09.1.454.CMB.1.raw
tcagacgcgagtatcacgaccggtgctcgatttagtgctatagacttgggtttggggggaggaactgctcagtcaggacccagagggaaccatggaagccccagctcagcttctcttcctcctgctactctggctcccagataccaccggagaaattgtgttgacacagtctccagcccaccctgtctttgtctccgaggggacagacgcctaccctctccctgccgagggccagtcaaggtagtaacttaacaacgtcgcgacgacgtcctggtcgacccaaaaccaaaaaccgtcggaccacggaccctcccgtacggccttccctacctattcttttacgacgtcgtacccttaccgaacgttacgggttcccctccgggaccgttacccgacggtcccgtaggttcgacgtcggcctaggtcggggtctacgggacgtacggtacttcgaccttacacccaacgtacgtcacgtacgactccgtggtacgtcgttagtacgtttaacgtttggttacgtttacttcgtagttacgtaacgttaccggttataccgtaacgttcgtacttacggtttacgaccggaacggggttaaccacggttaccgttagggaactacgtaaccggaacgttacgtaccggtgttacccgggacttccgtaaaccgtccgttacgtaccgtttaccggtttaccgttccttacccgtttacccgtttcccgacttacccg

SEQ ID NO: 107189 - DNA, 654 bp, Homo sapiens
  misc_feature: GYAE6OF02F3G7P.23.86.H09.1.454.CMB.1.raw
  modified_base (217)..(217): a, c, t, g, unknown or other
  misc_feature (217)..(217): n is a, c, g, or t
  modified_base (438)..(438): a, c, t, g, unknown or other
  misc_feature (438)..(438): n is a, c, g, or t
  modified_base (494)..(494): a, c, t, g, unknown or other
  misc_feature (494)..(494): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggcagacgccaccctctccngcgacgggccagtccagagtaacttaacaactgcgcagcctggtcgaccaaacgaaaaacctcggaccaggcctcccgaggcctacctcacttctttgatccgcctacctaacgtacggtacccgtggaccgtcccgagcccgtagggttccaggtcggtcgaacggtcggggtcgttacgggacacggtacttacgtctacgtacacccgtactccgacncgtaacgccgtaggccgacgtagtaatttggtttagtttagtttactcgtacgtanacggtacgttcgaactaacgtgtacgtttacgttcggacgtaaccgggactaacggacgttaggaacgtacgtaacgacgtaaggacgttcggtacgcgtaacggtcctaacgtgttaccttcgttacgtaccttccgttaccgttccccgattaacccg

SEQ ID NO: 107190 - DNA, 656 bp, Homo sapiens
  misc_feature: GYAE6OF02H04B5.23.86.H09.1.454.CMB.1.raw
  modified_base (264)..(264): a, c, t, g, unknown or other
  misc_feature (264)..(264): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagaaattgtgttgacacagtctccagcccaccctgtcctttgtcctccgaggggacagacgcccaccctctcccgtgccacgggccagtcagtagtaattaaccaactgccganacgcctggtcgacccaaacaaaaaccgtggacctaggcctaccccgaaggcctcctactaacttcttgactcgccctacgaaagtccgggtccctacggccgtacccgaacgccgtaacggttcaggtcggtacgacggttcgggtacgtacggggacacgtacgttcacgtctacgtaccactcgacgtcacgtcgtacggacgtcgtacgaagttagttttaggtcgtttaactcgtagtacgaacggtaccttgacctaagtcgtaactcgtttacggcctacggggactagcgtagggtacatacgtaacggtacgaacgttggtacggtctcggaacgtaccctagttcgttaccgtcgttacctacgttcccttaccccgataccg

SEQ ID NO: 107191 - DNA, 586 bp, Homo sapiens
  misc_feature: GYAE6OF02HUA22.23.86.H09.1.454.CMB.1.raw
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagacgcgagtatcacgaccggtgctcgatttagtgctatagacttgggtttggggggaggaactgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaaacaactgcgcagcctggtgacccaaacaaaaaacctggaccaaggctccccaggcctcctcatctttgatcgcctaccaagtacgggtccctgggccgtcccagcctagggttcagtggcaggtgggtctgggacagtacttcactctcaccancagcagctggagctgaagtntttggttagttattactgtctaacggtaaccgttgacctaacgttggtaaccttacgttttcgggaccgtaacggggaacctaaggccgtagggaacgtatacgaacgcgtaacgtggtacggctaggaccaacgtactccgtcgttacttacacttacccgtccgactacg

SEQ ID NO: 107192 - DNA, 609 bp, Homo sapiens
  misc_feature: GYAE6OF02FQ9Z5.23.86.H09.1.454.CMB.1.raw
  modified_base (390)..(390): a, c, t, g, unknown or other
  misc_feature (390)..(390): n is a, c, g, or t
tcagacgcgagtatcacgaccggtgctcgatttagtgctatagacttgggtttggggggaggaactgctcagtcaggacccagagggaaccatggaagccccagctcagcttctcttcctcctgctactctggctcccagataccaccggagaaattgtgttgacacagtctccagccaccctgtctttgtctccgaggggacagagcccaccctctcctgcacgggccagtcagagtacttaacaactgcgcagccgtggtcgaccaaacctaaaaacctcggacccacgcccctccccgaggcctaccgtactattcataggcacactaccaacgacgggccacgtcggacacgcccgaggcaggttcaggtggctaggtcgcgtcgngggacacgtacctcactctacacgatcagctagtcgtccgacctagtactagtttcgcttagtttatcttagcagtactacggtcgtccgacgtcggtactacgtacctaccgtcggtaccgaagggtcctacggacgtagggaacgtaggtaaccggtaaccgtacggttacggttaggaccgttacgaccctaaccttacgttaccgttgttacccg

SEQ ID NO: 107193 - DNA, 597 bp, Homo sapiens
  misc_feature: GYAE6OF02IKI2X.23.86.H09.1.454.CMB.1.raw
  modified_base (444)..(444): a, c, t, g, unknown or other
  misc_feature (444)..(444): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctccagataccaccggagaaattgtgttgacacagtctccagccacctgtctttgctccagggacagagccacctcgtcctgcagggccagtccagtagtattaacaactgcgatacgctggtgaccaaacaaaaacctggccaaggcctaccaggcctccgtcacgtctttggactcgcctcgaaacttcgggtccctgggccgtccaggcctagggttccaggttcggctaggtgggtactgggacaggtacgttacacgttctacgactaatcaagtcacggtctggacgcctagaagttgttttcgtntttaagtctgtacaacggttacgtgactaacgtaggtactacgtttggaaccgtaacgggaccgtaagcgtagacgtaagtacaacggacgtacgtaggtcggaactcggaacctaccgtactgttctacgtcctactccgttcccgattacg

SEQ ID NO: 107194 - DNA, 630 bp, Homo sapiens
  misc_feature: GYAE6OF02FTH3P.23.86.H09.1.454.CMB.1.raw
  modified_base (246)..(246): a, c, t, g, unknown or other
  misc_feature (246)..(246): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtcttgtctccaggggacagagccaccctctcctgcagggccagtcagagtattaacaactgcncagcctggtcgaccaaacaaaaaccgtcggccagggcctacccgaggtcctcctctattcctttgactcgcctaccaagtccgggtccctgggcccgtcccgacgtccgtacgggttcaggttcggcgtaggtcgggtcgtaggggacctaggtaccttccgacttccgtacaccctagtcgaccgactacgtcccgtagggaccgtcgtacgaaggtttagttttggttacgtttaagttcgtagttacgtacgtacgttgacttacgtgtaccttcggtttgaccgtacgggacaggtcgtggaatacgtcgaagacgttacgtggtcggtctagcccaacttgttcgttcgttccttactacgtcccgttacccgcttacg

SEQ ID NO: 107195 - DNA, 611 bp, Homo sapiens
  misc_feature: GYAE6OF02GH90X.23.86.H09.1.454.CMB.1.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (509)..(509): a, c, t, g, unknown or other
  misc_feature (509)..(509): n is a, c, g, or t
  modified_base (546)..(546): a, c, t, g, unknown or other
  misc_feature (546)..(546): n is a, c, g, or t
tcagacgcgagtatcacgaccggtgctcgatttagtgctatagacttggggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagacgccaccctctcctgcagggccagtcagagtattaacaactgcncancctggtgccaaacaaaacctggaccaggctacccaggctcctcattcttgatcgccctacaagtcgggtcctggcctccacgccaggttcaggtcggcaggtcgggtctaggggacaggtacttcgaactccgtacacatcagcacgctggactcgtaaggaattagtttggtatttaacttctgttacagtaaccgttcgactaactggtaactacgttttcggaccggtacggggtaacctaaggtcgtaacggntaaagtaccaagggtcctaaccgttgggttaccggtntaccgtccgaaacccttagtttccgacgtttccttaccaaccgttttccctacccgaccttaacg

SEQ ID NO: 107196 - DNA, 680 bp, Homo sapiens
  misc_feature: GYAE6OF02IHYQ3.23.86.H09.1.454.CMB.1.raw
  modified_base (306)..(306): a, c, t, g, unknown or other
  misc_feature (306)..(306): n is a, c, g, or t
  modified_base (449)..(449): a, c, t, g, unknown or other
  misc_feature (449)..(449): n is a, c, g, or t
  modified_base (482)..(482): a, c, t, g, unknown or other
  misc_feature (482)..(482): n is a, c, g, or t
  modified_base (589)..(589): a, c, t, g, unknown or other
  misc_feature (589)..(589): n is a, c, g, or t
tcagacgcgagtatcacgaccggtgctcgatttagtgctatagacttgggtttgggggaggaacgtgctcagtcaggacccagagggaaccatggaagccccagctcagcttctcttcctcctgctactcgtggctcccagactaccgaccggtagaaattcggtgttacgaccacacgtctccacgcccaccctgttcctttcgtctccggaggggacctaggacgccgacctctccgtgccaggcccaaggtcagtacgtactaacacgtgacgcacgcctgtcgacaaacaaaacgcggaccncggcctaccgacgcctccgactactctttacgactcgcctacctaacgtcggtccctacggcctcccagtccgtacggtcacggtcgtcgacggtcgggtaacgtcgtacgtacgtacttccacgtctccgacactccaagcncgacgtcggacaccgtagtcgttagttttcgtntttacttcggtttacggatttacggaaccgtttacgtcgtaacgtttacggtacgttaccgtttcgggaaccgttaacgggtaacgtacggtcgtaccggggtaaancgggtaaactagggtactaccggtaggtaccggtctacgactccggtacttcgtaccgttcgtccgtccttaccgtacccggttactacgg

SEQ ID NO: 107197 - DNA, 720 bp, Homo sapiens
  misc_feature: GYAE6OF02FMT5Q.23.86.H09.1.454.CMB.1.raw
  modified_base (151)..(151): a, c, t, g, unknown or other
  misc_feature (151)..(151): n is a, c, g, or t
  modified_base (263)..(263): a, c, t, g, unknown or other
  misc_feature (263)..(263): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctccagactaccaccgganaaattgtgttgacacagtctccagccacctgttctttgtcctccgaggggacagacgccaccctctcctgcgacgggtccagtcgaagtagtaacttaaacacgtgaccganacgtccgtggtcgaaccaaaactaaaaaccgtcggacccgaaggtcctaccccgaacggtccttacctccgtaatttccgtttagactccggaccttaccgtaaacgtaccggggttacccgtggtacccgtccgacgtaccgtacggttacgcggtcggacgtaggttcgggtcgtacgggactacgtaccgttactaccgtccgtaccgtactacgtacacgtacgacgtccgtaggaccgttcgtaacgtaggtttacttttggttagtttaacgttcgtacggtactaacggttaccgttacgtacctaacgtacgtttacggtttaacgttcgggaccggtaacgggtacaaggtccgtaaggactacgaagtaacggtgtacgcggttacgcgtacgaccgtaacgtacgtttacgttcttaaccgtgttaccgtcccttacgtacttacg

SEQ ID NO: 107198 - DNA, 813 bp, Homo sapiens
  misc_feature: GYAE6OF02HUHB0.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccacgcccaccctgttctttcgtcctccgagggacagacgccctaccctcctcctgcagggccagtcgaagtagtaacttaaaccgaactcggacgacgacgtccgtgggtaccgaacccaaaaccgtaaaaacccgtcggacccgaacgggccctaccccggacggcccttaccctacgttacttaccgttttacggacgttccgtaaccccgttacccgtaaacggttaccgggttcccccgtgggtaccccgttaccccgaccgggtacccgttacggtttaccgacgggtcgggaaccggtgggttacggggtccgtacggggacctaacggtacccgtttacgtacccgttctacccgtaacctacgtacgaccggtacacgtaccgtccggacgtaccgtaggttaaggtttaggtttttacgggttaactttacgtttaaccgtcgttaaccgttaacggttaaccggtagtaaccgttaacgttacggttactttagttaccggtacggtaacgggtactacggtcgaagtacgtacgaacgtacgtaacggtacgttaggtccggtaacgtccggacctaccgttagttcccgttctttcctaccgttccgttccccgtacccgtacgtaccg

SEQ ID NO: 107199 - DNA, 652 bp, Homo sapiens
  misc_feature: GYAE6OF02FYTQK.23.86.H09.1.454.CMB.1.raw
  modified_base (435)..(435): a, c, t, g, unknown or other
  misc_feature (435)..(435): n is a, c, g, or t
  modified_base (509)..(509): a, c, t, g, unknown or other
  misc_feature (509)..(509): n is a, c, g, or t
  modified_base (627)..(627): a, c, t, g, unknown or other
  misc_feature (627)..(627): n is a, c, g, or t
  modified_base (647)..(647): a, c, t, g, unknown or other
  misc_feature (647)..(647): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtcctccagccaccctgtctttgtcctccgaggggacagacgccaccctctcctgcacgggccagtcagataataacaactgcgcagcctgtcgaccaaacaaaaccgtggaccacggcctaccccgaggtcctcccttacacttcgtttagacttcgtacctaccgtaaacgtcggggttacccgtggacccgtacccacggccgtaacggttacgacggtcggacgtaggtgggtcgtacgggacacgtactcactcgaccacgtncgagctacgccgtggactcgaagttaacgttcgtttaggttacgtttaacttacgtagtccgtaagtaccgttntaccgaacgtttggtaacttacggttcggaaccggtagggtaaccaacgtcgggtagacgtagtaaccgacgtctagtcggtacgcggtacgaccctacgtagttccctgtttacctnttaccgttccccgttacccngttac

SEQ ID NO: 107200 - DNA, 719 bp, Homo sapiens
  misc_feature: GYAE6OF02G9TSB.23.86.H09.1.454.CMB.1.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (473)..(473): a, c, t, g, unknown or other
  misc_feature (473)..(473): n is a, c, g, or t
  modified_base (644)..(644): a, c, t, g, unknown or other
  misc_feature (644)..(644): n is a, c, g, or t
  modified_base (713)..(713): a, c, t, g, unknown or other
  misc_feature (713)..(713): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccaccggagtaaattgtgttagacacgtgtcncgcgccctacctgttcttcgtaccncgggaaggaccaggaccgaccctaccctcttccgngacgaccgggcacgtanagtaacgtaaactaaccacgtcgcgacgacgtccgtaggtaccaaccaaaaactaaccggtcgaccgaccgtcccacgacgtcctactattacttcgttacacgttcctacctacggtaacggtcccgggtccgtcgggtacccgtcaccggtccgtagttcggtaggcggtacgtagggttccgtacggtcgaacgtacttactccgtactacgccaacngacacgtcgaccgtaggcgtacgcgttaagttagggttttgtttcggtttagtttaactcggtacgttacgaacgttccgtactaacgtaacggttctaacggtttacggtccgggaaacgtaccggtaacgaaggtggtaccggtaatacggtaaccacgggttaaccgnggttcggacgtcgtaaccgaccttacggactttcgttcgttaccttaggttcccctttcgaccccgttnttaacg

SEQ ID NO: 107201 - DNA, 737 bp, Homo sapiens
  misc_feature: GYAE6OF02F4U0W.23.86.H09.1.454.CMB.1.raw
  modified_base (443)..(443): a, c, t, g, unknown or other
  misc_feature (443)..(443): n is a, c, g, or t
tcagacgcgagtatcacgaccggtgctcgatttagtgctatagacttggggtttgggggaggaactgctcagtcaggacccagagggaaccatggaagccccagctcagcttctcttcctcctgctactctggctccagactaccaccggagaaattgtgttgacacagtcctccagccaccctgttctttgtcctccgaggggtacagacgcccaccctctcctgcgagggccagtcagagtaactaacaactgcgacagccgtgtacgaccaaaacaaaaccgtcggaccacggtcctcccgagcctacctacgtaacttcgtttagacttccgtacccgtaccgaaaggtccgggtcctcgggtccctacccgagtacccgtaggttacgaggtcggtacgtacggttcggggtacgtacggggaacttagaccgttacnccttaccgtaaccaccctagttacacggcctaggtaccgtaggactcgtaacgtaagttacgtttagttaacgtttacgtaccgttgtaacgtaacggttaccgttgtaacctaacgtttacgtaaccgttacggttttacggaccgggtaacgggtaacctaacggtacgttacggggaatacgttaacgacgttaacggtacgttagggtaccgttacgacggttacccgtaacgttacgtttaaccttcgttaccgtttaccgtaccggtttacccctacccgtacgtacc

SEQ ID NO: 107202 - DNA, 595 bp, Homo sapiens
  misc_feature: GYAE6OF02G3452.23.86.H09.1.454.CMB.1.raw
  modified_base (360)..(360): a, c, t, g, unknown or other
  misc_feature (360)..(360): n is a, c, g, or t
  modified_base (458)..(458): a, c, t, g, unknown or other
  misc_feature (458)..(458): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttcgtctccaggggacagacgccaccctctcctgcagggccagtcagagtattaacaactgcgcagccgtggtcgaccaaaacaaaaaccgtcggaccacgccctacccgacggcctcgtcagtttcagtcggtacactactaccgaacgacggccactggcactcccgaggcnggtcagtggcaggtgcgtcgtggacacgcttcacttcactagactcgacgcaggtcgtccgaccgtgacgttatttcggacttaagtttacttcgttntacgtacgtacgtaacggttgccgtaccgtcgggtaccttacgtccgtaccgttccggaccggtaacgcgtacgtacgaggtacgacggtaaggaaacgtcgtggtacgccgtagtacccacgtcgttacctgttcc

SEQ ID NO: 107203 - DNA, 712 bp, Homo sapiens
  misc_feature: GYAE6OF02IPVWE.23.86.H09.1.454.CMB.1.raw
  modified_base (230)..(230): a, c, t, g, unknown or other
  misc_feature (230)..(230): n is a, c, g, or t
tcagacgcgagtatcacgaccggtgctcgatttagtgctatagacttggggtttgggggaggaactgctcagtcaggacccagagggaaccatggaagccccagctcagcttctcttcctcctgctactctggctcccagactaccgaccggagaaattgtgtcaacacacgtctccagcctaccctgttctttacgctaccgaggggacagacgacccacctcgtaccnggccagggccaagtctaacggaataagtaaacctacgacgcgagacgtaccgtaggtacgaccgtaaaactaaaaaccgtggaaccgacggaccgtaccgaacggcctaccgttacacgtttacgttcgacgtcgtaccgttaccgtaaacgtacgggtccctggaccgtaccgtacgaccgtaggttccaggtcgtgtaacggtggtacgcgggtaactaggtaccttactacgtctaaccgtacctagttaccgaacgtcgaaccgtacggtacggtaacgtcgttaagtaacggtttaagttttacgggtttagtttaacgtttacgaagttaccgtaacggtacggtttaccgacgttaaacgtcggtacctttaacggttacggtacgtacggaacgtacgacgttagagtaacacgtagacgagttctagggcttagaccgtacagttcttacgccttcaacttcgtccgatacgg

SEQ ID NO: 107204 - DNA, 778 bp, Homo sapiens
  misc_feature: GYAE6OF02FI8CI.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctccaggggacagacgccaccctctcctgcgacgggccagtcagagtataacaactgcgcagcctggtcgaccaaacaaaaccgtcggaccacggcctacccgaggcctcctactattcgttgactcgtccctacaacgtaccgggtcccctgggtcccgtcccgacgtccgtacggttccgtaggtcggcgtacgggttgggtccgtagggacgtacgtaaccttcaacgtcctaccgacctataccacgcacgtcgtaggacgtccgtaagtaacggtttattttgggtacgtttaacttacggtacgttaacgtaaccgttacgttacgaccgttaaaccgttcgggttaaaccttaccggttttccgggaaacccgggttaaccggggggtaaccctaaacgggtaccggttaacggggaaacgttacccggttaacgaaaccgggtaccgggttaaaccggttgggtttaacccgggtacccggtttacggaaccccgttaacccgttacgtttaccggttacggtttacccctttaaccggtacccgtttttcccccgtaaccccgggtcctttaaacccgg

SEQ ID NO: 107205 - DNA, 778 bp, Homo sapiens
  misc_feature: GYAE6OF02FX5L4.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctcaggggacagacgccaccctctcctgcgacgggccagtcagagtattaaacaactgcgcagccgtggtacgacccaaaaccaaaaaccgtcggaccgaacgggtcctacccccacggggccttccccttctaacgttccttttaggacttcggcccttacccgtaacgttaccggggttcccctgggtcccgtccccgaggtccccgaagggtttcaacggttcgggaccgtagggttcggggtcgtcggggaacgtaacggtacctttacgaaccttccgtacaccctaatcccgaacgcctaccggtcccggtacgggtaccgtcccgtagggtaaagtttcggttttttagggttaacgttttaacgtttaacgttcgttaaccgtaacgggttaaccgtttcggaacgttaacgtttacggtaacctttacgttttacgggacggtaaccggggtaacctaaaggtcgtagggtacgtaagtaccgaaacgtccgtaacgtgggtacgccgttacggaccctaaccgtacgttcgttaccgttaccttaccgttccgttcccgtttccccgtacttacccgg

SEQ ID NO: 107206 - DNA, 703 bp, Homo sapiens
  misc_feature: GYAE6OF02IB894.23.86.H09.1.454.CMB.1.raw
  modified_base (152)..(152): a, c, t, g, unknown or other
  misc_feature (152)..(152): n is a, c, g, or t
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
  modified_base (565)..(565): a, c, t, g, unknown or other
  misc_feature (565)..(565): n is a, c, g, or t
  modified_base (618)..(618): a, c, t, g, unknown or other
  misc_feature (618)..(618): n is a, c, g, or t
tcagacgcgagtatcacgaccggtgctcgatttagtgctatagacttgggtttgggggaggaactgctcagtcaggacccagagggaaccatggaagccccagctcagcttctcttccctcctgctactctggctcccagataccaccgganaattgtgttgacacagtctccagccaccctgtctttgctccgaggggacagacgcccaccctctccgtgcgngggccagtcagacgtactaacaacgtgacgtcagcctgggtnacctaaaacaaaaccgtcggacctaacggccttaccccgaaggtccttacccgtacacgttaccgtttacggactaccggtaccccttacccgtaaacgttaccggggttcccccttacgggtacccgtacccccgtaggccccgttaagggttccaaggtcgggctaggttcggggtaccttaggggactaggtaccttacgaactcctaccgactagtaccgagaccgagccgttaggacgtccgtaagtaacctttagttttggtaacttttataccgtatccgtaagtaccgttnactacgttcgtaactcgtttacgacggtacggtaaccaaggtccgtaggtaanacgtacgaacggtctagtggtaccgtgtaccggactaccgttagacgttcgttacgtacctacggttccttaccccgattaaccg

SEQ ID NO: 107207 - DNA, 572 bp, Homo sapiens
  misc_feature: GYAE6OF02I6VZ3.23.86.H09.1.454.CMB.1.raw
  modified_base (261)..(261): a, c, t, g, unknown or other
  misc_feature (261)..(261): n is a, c, g, or t
  modified_base (421)..(421): a, c, t, g, unknown or other
  misc_feature (421)..(421): n is a, c, g, or t
  modified_base (512)..(512): a, c, t, g, unknown or other
  misc_feature (512)..(512): n is a, c, g, or t
  modified_base (524)..(524): a, c, t, g, unknown or other
  misc_feature (524)..(524): n is a, c, g, or t
  modified_base (544)..(544): a, c, t, g, unknown or other
  misc_feature (544)..(544): n is a, c, g, or t
  modified_base (556)..(556): a, c, t, g, unknown or other
  misc_feature (556)..(556): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtggttgacacagtctccagccaccctgtctttgtctccaggggacagagccaccctctcctgcagggcccagtcagagtaattaaccaactgcgcagcctggtnaccaaacaaaactggaccaggctacccgaggcctcctcactctttagactcgcctacaacgttacgggtcccaggtcccgtacccgacgtcccgtacggttacaggttcggccgaggttgggtcgtagggaccagtccttcgactcgtaccacactcganaccgacgccgtgacgcttaggagttatttggtagtttattcgtgtacgagtaccgttgacctaagtgtacttcgtggacctagggactagntgagactagagntactgtcggctcgacacctntcgtcgttcctntctaccgtccgactcg

SEQ ID NO: 107208 - DNA, 687 bp, Homo sapiens
  misc_feature: GYAE6OF02IDWLH.23.86.H09.1.454.CMB.1.raw
  modified_base (257)..(257): a, c, t, g, unknown or other
  misc_feature (257)..(257): n is a, c, g, or t
  modified_base (454)..(454): a, c, t, g, unknown or other
  misc_feature (454)..(454): n is a, c, g, or t
tcagacgcgagtatcacgaccggtgctcgatttagtgctatagacttgggtttgggggacggaactgctcagtcaggaccagagggaaccatggaagccccagctcagcttctcttcctcctgctactctggctccagactaccacggagaaattgtgttgacacagtctccagccaccctgttctttcgtcgtccgaggggtacagacgcccgacctctcctggcagggaccagtcagtacgtataacaactgacncacgcctaggtcgaccaaacaaaaccgtggccacggcctaccgacgcctacctctattcgtttagactcggacccttacgaaacggttcgggtccccgtcgggacccttacccgacggtaccgttacggttcgtacggtcggacgtacgggttcgggtaccgtgggaaccacggtacctttcaccttcgacctaccntacgacgtacgtacgttcgtacccgtaccgtacgtacgttactttgacttagtttactacgtcgacttgaccgtaggtcgacgtcctacggttacctcgtaccgtccgttaccgggactacgggtaccgttcgacggttacgaacgaagttacggaaacggttcggtggtaccggtagtcgaacccttcgttacgtaccgttccgttaacgttctacccgttcccgttacccg

SEQ ID NO: 107209 - DNA, 778 bp, Homo sapiens
  misc_feature: GYAE6OF02IDTMA.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctgctccagataccaccggagaaattgtgttgacacagtctccagccacctgtctttgtctccgaggggacagacgccaccctctcctgcagggccagtcagagtattaacaactgcgcacgcctggtcgacccgaaaacctaaaaaccgtcggacccgtaggacctccccgaaggcccttccctacgactttcgtttcgacttcggacccttaccgaaagttaccggggtcccctcgggacccgtccccacggtcccgtaggtttccgaaggttccggcgttacgggttcgggggtaccgtaggggtaccaacggttaccgtttaccgaaccgttccttaacccaaccctacttcccgaagggtacccaaccggtccgttacgggtaacccgtccgttaaggtaaacggtttagttttttgggttaacgttttaacgttacgttacggtaaccgtaaggttaacccgttttgaaccgttaacgtttacggttaaccgttacgtttttaccgggaacccgttaacgggaaccgtaacgggtcgtagggtaagacttaacgaacggaccgttaacgtcggtacgggaccttaccggtacgaacccttagttcctcgtttcttacgtaccgttcccgtttccccacttaacg

SEQ ID NO: 107210 - DNA, 976 bp, Homo sapiens
  misc_feature: GYAE6OF02GSGSI.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctcaggggacagacgccaccctctcctgcagggccagtcagagtattaacaactgcgcagccgtggtcgaccaaacgaaaaacccgtggacccaagggcctccccgaaggtcctccctcgtaacttcctttaggacttcggaccccttacccgtaaacggttaccggggtcccccgttcggggtaccccgttacccccgtaacgggtccccgtaacggggtttacccgtaaggggttccgggtacccgtaaggggtttccgggggttaccggttaggggggaaccctaacggttaacccgttttccgaaacccgtttccgtaaaccccgtaacccgttaaaccgttaacccgaaaacccgttaccgggtacccggttaaccggggtaaccgttccccggttaaagggttaaacggtttttaacgggtttttttacggggtttaacgtttttttaaacgtttaaccggttttaaccgggttacgttaaacccgggttttaaaacccgggttttcggtaaacccggttaaaccgttttacgggttaaaccccgttttaccgggttttttaaccggggaacccggttaaacgggggggtaacccctaaacgggtccgggttaacgggtaacggttaacgttaacccggtaaaagggtacccgttaaaccgtttcggggtacggtaccgttaccgggtaaccctaccccgttagttacccggtttccggttttaccttaaccccgttaccggttacccccgttttaccccggtacctaaccgttttccgg

SEQ ID NO: 107211 - DNA, 644 bp, Homo sapiens
  misc_feature: GYAE6OF02IDVEJ.23.86.H09.1.454.CMB.1.raw
  modified_base (248)..(248): a, c, t, g, unknown or other
  misc_feature (248)..(248): n is a, c, g, or t
  modified_base (353)..(353): a, c, t, g, unknown or other
  misc_feature (353)..(353): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
tcagacgcgagtatcacgaccggtgctcgatttagtgctatagacttgggtttgggggagaactgctcagtcaggacccagagggaaccatggaagccccagctcagcttctcttcctcctgctactctggctccagataccaccggagaaattgtgttgacacagtcctccagccaccctgttctttgtctccgagggacagcgtccacctctccagccaggccagtcagacgtataaacaactgcncacgcctggtcgaccaaacaaaaaccgtcgaccgacggtcctccgacgtctcctctattcttagctcgcctacagtacggtcctggcctcgacgcgtacgtacgngtcgtacgaggtcggtagtcggagtcacgttcacttcgacactntcgacncgcgacgtcggctcgtagtagtttagttcggttatttacgtagtcgtaacctacgggtttaaaccgtgtaaccgttagtacgttacggtttaccggtttacggacggtaacggtaacgcggtaaccggtagggtacacggtacgtaacgggtactaggtcggtaccgtcgtaacttcccgaacgtttaccgccgtttcggttaccttccttacccgtttaccccggtcctaccgtaacccg

SEQ ID NO: 107212 - DNA, 718 bp, Homo sapiens
  misc_feature: GYAE6OF02HJ8XI.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctcggcctccagataccaccggagaattgtgttgacacagtctccagcccaccctgtctttgtcctcgaggggtacacgacgcccaccctctcctgcgagggccagtcagtagtaattaacactcgcgctacgccgtggtacgacccaaaacgaaaaccgtcggaccgacggcctaccccgacggtccttacccgtactacgtttcgtttcgacgttccgtacctaccgtaacgtaccgggtcccgtcggtccgtaccccacggtcctacgggtctgggtcggtcggtagggtcgggttcggagggtccaggttaccttacctccttacgtaccaaccgtactacggaccgcgtacgccgttggaacgttccggtaagtaacgtttggtttttggtacgttttacgttcgtacgtaactacgggttacgttacggaaccttagttaccgttagttaccgttcccggaaggtaaccggtaccagggtaaccgacgtagtaacgtacgtaacgtaccgtaggttcgaccgtacgtccggaacctacgtacgttcgtacttccctacgttcccggttcccttcggttacctcc

SEQ ID NO: 107213 - DNA, 828 bp, Homo sapiens
  misc_feature: GYAE6OF02IFBHA.23.86.H09.1.454.CMB.1.raw
tcagacgcgagtatcacgaccggtgctcgatttagtgctatagacttggggtttgggggaggaactgctcagtcaggacccagagggaaccatggaagccccagctcagcttctcttcctcctgctactctcggctcccaagactaccaccggagtaaacttgtgttgacactagtcctccagccaccctgttctttgtcctccgagggacagacgcccaccctctcctgcgacgggccagtcagtagtaacttaaacaacgtcgcgacacgccgtaggtcaaccaaaacgtaaaaaccgtcggacccgaacggtccctaaccccgaggtacctccgtactaactttcgttacgacttccggtacctaccgtaaacggttccgggtacccgtcgggccgtcccgaacggtccggtacggttccgaggttcgggaccgttacgggttccggggtacgttacggggactaaaccggttacccgtttccgaaccgtttccaaccgtaacctacgtaccgtaacgtccggacgtcccggtagggtaccctggttaacgttaaggtttcgggtttttgttaacgtttaacgttacggttcgtaaaccggttacgttaaccttaccgacgttaccggttaccgttacggtttaaccgggttaccggaccgggttaaaccgggtccgtaacggttacgtaccggggtaaatttacgggaacgacgtaaaccggtcgttaggggtccctaacgggtccaacccgttaccggtacctttaccggggttccgtaccctttaaccgtcccgtttcccggttaccccgtaatttacccgg

SEQ ID NO: 107214 - DNA, 826 bp, Homo sapiens
  misc_feature: GYAE6OF02HSV2G.23.86.H09.1.454.CMB.1.raw
  modified_base (134)..(134): a, c, t, g, unknown or other
  misc_feature (134)..(134): n is a, c, g, or t
  modified_base (623)..(623): a, c, t, g, unknown or other
  misc_feature (623)..(623): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggcnccctagataccaccggagaaattgtgttgacacagtctccagcctaccctgttctttgtcctccgaggggacagacgcccaccctctcctgcacgggccagtcagagtattaacaactgcgacagccgtggtcgaccaaaacgaaaaacctggaccgacggcctaccccgaaggccttcccgtactaagtttcctttacgacgttcggtaccctaaccgtaaacggttcccgggttacccctcggggtacccgttacccccgacggtcccggttaaggttccgacggttcgggaccgttagggttcggggtaccgtacggggaactacggttacccgttacgtaccttaccgttaccaaaccttaacgtccgacggtaccgaaccgtaccggttacggacgttacccggttaaggtaaacgttttaggtttttggtttacgttttaaacgtttaccgtacgtttaacccggtaaggttaaacccggttnttaacccgtaaacgttcgttaaccttttcggggtttacggaaccgtaaccgggggttaaccaaacgggtttacggacgttaaagtcgttaaacgaacggttaaccgttacgtcgggtaaccggtcttaccggtaccgtaaacgttacgttttccggtaccgtttcgttaaccgtcccgtttacccctacccgtacttaaccgg

SEQ ID NO: 107215 - DNA, 664 bp, Homo sapiens
  misc_feature: GYAE6OF02H5YUV.23.86.H09.1.454.CMB.1.raw
  modified_base (429)..(429): a, c, t, g, unknown or other
  misc_feature (429)..(429): n is a, c, g, or t
  modified_base (582)..(582): a, c, t, g, unknown or other
  misc_feature (582)..(582): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctccagactaccaccggaagtaaattgtgttgacacagtcctccagcccacctgttctttgtctcgaggggacagacgcccaccctctcctgcgacgggccagtcagtagtaattaacaactgcgcacgtccgtggtcaaccaaaacaaaaccgtcggaccgacgccctaccggacgtcctacctctacttcttagactccgacctaccgaagttaccggtcctcggccgtcccgacgtccgtacggttcaggtcggacgtcggtgggtcgtaggactacgtactcacctccacacnctacagcacgtcgtggaccgtcgtagtaagttgttttaggttcgtttaacgttctacgtacgtaacggttaacggttcgtaacgtaacgtcggtttaacttacggtttccgggaacggtaccgggtaaccagggtaccgtaggtaccgtaaanaccgtacgaccgtagtcgggtagtcgtacgacctaccgttatcggttctaccgttacctaccgttcctaccccgtgtaaccc

SEQ ID NO: 107216 - DNA, 775 bp, Homo sapiens
  misc_feature: GYAE6OF02F3WB4.23.86.H09.1.454.CMB.1.raw
  modified_base (142)..(142): a, c, t, g, unknown or other
  misc_feature (142)..(142): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (488)..(488): a, c, t, g, unknown or other
  misc_feature (488)..(488): n is a, c, g, or t
tcagacgcgagtatcacgaccggtgctcgatttagtgctatagacttgggttgggggaggaactgctcagtcagacccagagggaaccatggaagccccagctcagcttctcttcctcctgctactcgtcggctcccagtanaccgaccggagtaaattgtggttcaacactagtcctaccagccctaccctgttctttacgtcctccgaggggtacagaccgcctaccctcgtcgtacgcaacgggcctatacgacgtagttaaacctaacgtacctggacgcggtaacgtccnggttaacgaccctaaaaacaaaaccgtccggaccaccggtacctccccgacgtccttcccgntacctttggttacgtactccgcctaaccgtaaggttccggaccgttaccgaccggcctacgcccggttagttaccggagtcggtccgtaggtcggcgttaccggaagacctttcggaactcctaccgtacnccaacctgtaccgtaccgcgtacccgagtccggtacgttacggttagtttaccggtttaggttaacgtttacgttacgtacgttaacggttacgtaccggttacgtaccgttaggttaccctttacgttaccggtttaccggacgggtaccccgtaacgggtaggtaccgtagggtaccgttaacgaacgtaacgacgtaaccggtcgtaacgggtataccgtaccgttaccgtcgtttaacggtctttaacccgttcctaacgttccctaccccgttacttaacgg

SEQ ID NO: 107217 - DNA, 756 bp, Homo sapiens
  misc_feature: GYAE6OF02FSEBB.23.86.H09.1.454.CMB.1.raw
  modified_base (170)..(170): a, c, t, g, unknown or other
  misc_feature (170)..(170): n is a, c, g, or t
  modified_base (278)..(278): a, c, t, g, unknown or other
  misc_feature (278)..(278): n is a, c, g, or t
tcagacgcgagtatcacgaccggtgctcgatttagtgctatagacttgggtttgggggaggaactgctcagtcaggacccagagggaaccatggaagccccagctcagcttctcttcctcctgctactctggctcccagactaccgaccggagtaaattgtgttgacacngtcctccagccaccctgttctttgctccgagggcagagccaccctcgtcctgcacgggccagtccagtagttactaacactgcgcacgctggcgaccaaacaaaccgnggccaggcctaccccgaggtccttaccgtctacgttccgtttagccttccgtccccgttaccaaaggttccgggtttcccccggtaggtccccggtacccacgggttacccggttaaggtttccgacgggttcggtaccgtagggtttccggggtacgtaggggacctaggttacccttcgtacctaccgtacccacctcgtaccgacgacgtccggtccggtaggtaccgtacgtagtaacggtttacgttttagggtttaccgtttaatacggttaccgttaaccggttaacgtacccgggtttacgaacccgtaaacggtttccggtaacctttacgggttttccgggaacccgggttacgggacccgttaaggaccgttaggacggtaacgtaccgaagtaccgtacggtacggcgtaccgcgaccgttcccaacgttcggttacgtctacggtacttcccgtacctccgtacg

SEQ ID NO: 107218 - DNA, 824 bp, Homo sapiens
  misc_feature: GYAE6OF02INS8N.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctccagataccaccggagaaattgtgttgacacagtctccagccaccctgtctttgtctccaggggacagacgccaccctctcctgcaggccagtcagagtaattaacaactgacgcacgcctggtcgaccaaaacgaaaaaacctgggacccaacgggaccttacccgaggtcctacccgtacaacgtttccttttaggaacttcggtaccccttaccgaaaagtttaccggggtccccgtacgggtaccgtccccgaacggtaccgtaagggttccaagggttcggacgaggttcgggtacggtagggaacctaggtaccttcgaacctccgtaccaaaccactacgaacgtccgtaagccgtacggtacgaccgttaaggtaacggttaacgtttttgggttaacgttttaaacgtttaaccgtacgttaaccggtacgttaaaacccggtttacgaaccgttaaaaccggttagggtttaaccttaaccggttttttaccggggaaccggttaacgggggtaaacctaaacgggtacggttaacgggtagtaaacgttaaaccgaaacggttacggtaacggttcggttacggggtaccttaaccggaaccggttaacctaacggtttaccgtttacgggttccctttaaccgtaaccggttttacccttaccccgggactttaaccg

SEQ ID NO: 107219 - DNA, 751 bp, Homo sapiens
  misc_feature: GYAE6OF02HPD1S.23.86.H09.1.454.CMB.1.raw
tcagacgcgagtatcacgaccggtgctcgatttagtgctatagacttgggtttgggggaggaactgctcagtcaggacccagagggaaccatggaagccccagctcagcttctcttcctcctgctactctggctcccagataccaccggagaaattgtgttgacacagtctccagccaccctgtctttgtctcgaggggacagagcccaccctctcctgcgacgggccagtcagagtaattaaacaactgcgcagcctggtcgaaccaaactaaaaaaccgtggaccgacggacctaccccgaaggtccctcctctaacttcctttaggacttcgacccttaccaaacgttaccgggtcccctacgggcccgttacccgacggaccgtagggtttaccaggtcggacgtacggttcggggtaccgtggggaacctacgggtacctttcgaccttcctaccaacctagtaccgacgccgtaacggccgtacgggacgtacccgtaggtaaagtttgtttttgggttaagtttttactttaacgtcggttaacgtaaacggttaaccgttcgtaaccgtaacgtttacggttaaccttcgggttttaccgggaacccgggtaacgggggtaacctaagggtcgttaagggtaacgtaacgtaacgaacggtacgaacggttggtacgggtactccgacctaacgtaacgttcgttcgttaccttacgtactttaccccgttcccgaccgttac

SEQ ID NO: 107220 - DNA, 491 bp, Homo sapiens
  misc_feature: GYAE6OF01BQLQQ.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagagtcaccatcacttgccgggcgagtcaggacattaacaactatttagcctggtatcagcagaaaccaggaaagtacctaaactcctgatctatggtgcatccactttgcaatcagggctcccatctcgattcagcggcagtggatctgggagagatttcagtctcaccatcagcagcctgcacgcctgaacgacgttgctaacttattactgtacaaaagtataaacagtcgcccctttcacctttcggccctgggacccaatcgtagaggacaaacgactacgg

SEQ ID NO: 107221 - DNA, 692 bp, Homo sapiens
  misc_feature: GYAE6OF01CHB3R.23.50.E06.1.454.CMB.1.raw
  modified_base (227)..(227): a, c, t, g, unknown or other
  misc_feature (227)..(227): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctcctgtctgcgtctgtgggagccagagtccacatcacgttgccgggnagtcaggacattaaacaacttatttagcctggtactacgagacgaaacgaaaccggaagggtaaaccttaacctaaacctcgtagtactacgtagtggtacactactaccgttattacgactaacgtacgggacggtccctacctattcctacgttactacggacggtccgacgtaggtacggtacttgggtaagggtagtaacgtttactttaccgtaacgttcctaaccgaactacgtacgacgtacgaccgtcgtacgacgaccggtacgtaaggtaacgttacgttacgaacctttaacgtttaacgtttacgtaacgttaaacgtaaaaagttaacctaaacggttacccgttacccgttttacccccgtttacgtttaccccggtttaccgggtacccgtaccgggtaaactaaggttaccggtaacggtacgtaaaaccgtaaacgtacggttacggg

SEQ ID NO: 107222 - DNA, 520 bp, Homo sapiens
  misc_feature: GYAE6OF01BE21G.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagagtcaccatcacttgccgggcgagtcaggacattaacaactattagcctggtatcagcagaaaccagggaaagtacctaaactcctgatctatggtgcatccactttgcaatcagggcctccatctcgattcagcggcagtgatcgtgggagagtatttcagtctcaccatcagcagcctgcacgcctgaagcgttgactaacttattactagtacaaaagtataacgtagttcttaccctttctaccttttccggccccgttaggggtaaccctaagttcgtaacggtaaggtaccaaacggtacgttacggg

SEQ ID NO: 107223 - DNA, 504 bp, Homo sapiens
  misc_feature: GYAE6OF01BJ3I4.23.50.E06.1.454.CMB.1.raw
  modified_base (473)..(473): a, c, t, g, unknown or other
  misc_feature (473)..(473): n is a, c, g, or t
  modified_base (498)..(498): a, c, t, g, unknown or other
  misc_feature (498)..(498): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatgggggtggatcagcgtctacgatgataacacagactttgcacagaagttccgagggcagagtctccatgagcacagacacatccacgagcacagtcacatggaactgaggagtctagacatcgtgacgacacggcgtgtattatgtgcgagaggggcacgntccgtgtacgtggtcggttgcgtgngtacgg

SEQ ID NO: 107224 - DNA, 557 bp, Homo sapiens
  misc_feature: GYAE6OF01CQXNW.23.50.E06.1.454.CMB.1.raw
  modified_base (235)..(235): a, c, t, g, unknown or other
  misc_feature (235)..(235): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatccctccctgtcctgcgtctggtgggagccaggacgtccaccatcacgttggccgggngagtcaggacattaacaacttatttagcctggtatcagacaagaaaccgaagggaaactaacctaaactcctagatctatggtgcatcctactttgactaatcgaggcctcccatcctcgtacttcgagcggcaggtggtagtcgtagggagagtatttcgagttctacaccatcagcacgccgtgcacgcctaggaacgtacgttcgacctatttacttactagtactaaaagttactaacgtacgtcctacccgtttctaccgtttccggccgttacggtaacctaggtacgtaaggacggtaaccaaacgtacgtacgg

SEQ ID NO: 107225 - DNA, 607 bp, Homo sapiens
  misc_feature: GYAE6OF01DB6OL.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctggtgggagccagagtcaccatcacttggccgggcgagtcaggacaattaacaacttattagcctggtatcagacaagaaaaccgaagggaaaagtaacctaaactcctgatctagtggtgcatccatttgctaatcgaacgggcctcccattcctacgtattcgaggcggctaggtggatcggtagggagtagtatttcgagtcctacaaccatcagccacgcctgcacgtccctaggaaacgtcgttagaccttaacgtttacttacgttagtaactaaaaagttacttaaacctacggttccgttaccccccgttttacgtacccgttttcccgggtaccccgttacgggtaaaccccttaaaggttcggttaacgacgggttaaaccgaaaaccggtaacggttacggg

SEQ ID NO: 107226 - DNA, 536 bp, Homo sapiens
  misc_feature: GYAE6OF01BGVBN.23.50.E06.1.454.CMB.1.raw
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtcctccatccctccctgtctgcgtctggtggganccagacgtccaccatccacgttggccgggcgagtcaggactattaacaacttattagcctggtatcagcaagaaaccgaggaaagtacctaaactcctagactacgtatcggtgcactcctactttgactaactcgacgggcctccatctcgatcagcgnagtgatcggtgggagtagtacttcagtactacacatacagcacgcctgcagccgtagaacgtagtcgactaacttattacgtataactaaagtactaagtacgtccgttacccttcgtaccgttccggtccgtacggaacctagtcgtaacgtagtacaaacggtgtacgg

SEQ ID NO: 107227 - DNA, 524 bp, Homo sapiens
  misc_feature: GYAE6OF01BBMNL.23.50.E06.1.454.CMB.1.raw
  modified_base (357)..(357): a, c, t, g, unknown or other
  misc_feature (357)..(357): n is a, c, g, or t
  modified_base (517)..(517): a, c, t, g, unknown or other
  misc_feature (517)..(517): n is a, c, g, or t
tcagacgcgagtatcacgaccggtgctcgatttagatctactgacaacacacaagggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacacggcccctggacaagggcttggagtggagtggggtggatcagcgtctacgatgataacacagactttgcanagagttccagggcagagtctcatgagcacagacacataccacgagcacagtctacataggaactggaaggatcgtgacatcgtagacgacgacggtccgtgttacttagttcggtggacgtaggaggggcacgtactccgtggtagtgggtgttgcgtgngtacggg

SEQ ID NO: 107228 - DNA, 533 bp, Homo sapiens
  misc_feature: GYAE6OF01AUMIN.23.50.E06.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtggganccagagtccaccatcacttgccgggcgagtcaggacattaacaactatttagcctggtatcagcagaaaccagggaaacgtacctaaactcctagatctatggtnacatccactttgacaatcgaggctcccatctcgattcagcgnagtgatcgtaggganagtattcgagtctacacctatcagcagcctgacngcccgtagaacgtacgttgacttaacttatttactagtaactaaaagtataacgtagttcccgtacccctttctaccgtttcccggcccttacgggacctaaagttcgaaggtacggtaaccaaacgtcgtacgg

SEQ ID NO: 107229 - DNA, 534 bp, Homo sapiens
  misc_feature: GYAE6OF01ELZHC.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagagtccaccatcacttgccgggcgagtcaggacattaacaactattagcctggtatcagcagaaaccagggaaagtacctaaactcctagatctatggtgcatccactttgacaatcaggcctccatctcgattcagcggcagtggatcgtgggagagtatttcagtctcacatcagcagcctgcacgcctagaacgtacgttgactaacttattactagtaactaaaagtactaacgtacgtcgttcccctttactaccgtttccggcccgttacgggaaccttaacgttcggtaacggaacggttaacgtaaacggtacgttacggg

SEQ ID NO: 107230 - DNA, 811 bp, Homo sapiens
  misc_feature: GYAE6OF01C2SR7.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtcctccactcctccctgtctgccgtcgtggtgggacgccagacgtccaacctatccgacgttcggacccggggcgtaacgtccgaaggtaacctaactttaaaacctaaacgttttaacgttttaacggcccgtttagggttaactaccgaacggaaccgaaaacggaaaaacccggtaaaggggtaaaaccgtttaaccccttaaaaaccgttcccgtaggtaacttaccgttaagttcgggtactacctacgttacccgttaacgttttcgaccgttaaacgtccggtaacggggtccccttacccgtattcccgttacggtaacgtttccggaacgggtccgggtacgtaacgggtcgggtaacgttccgggtaggggaacgttaaggttacgtttacgtacgttcctaccgtaactactaccgaacgtacctaacggccctaggacccgtacgtcgtacggtaacgtccggttacgtaaccgttaactttagttaccgtaagttaactaaaacgttaacctaacgtccgtttaccgtaccccttttaccggtacccgttttaccccgggaccgttaccggtaaccttaacggtacgttaacgggaacgttaaacccggaaacgttcggtaacggg

SEQ ID NO: 107231 - DNA, 573 bp, Homo sapiens
  misc_feature: GYAE6OF01B0WMB.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatcctttttcttggtggcggcagcaacaggtgcccactcccaggttcaactggaacaatctggagctgaggtgaagaggcctggggcctcgagtgaaggtctcctgcaaggcttctggttacatctttaggaactatgctatcaactggtgcgacagcccctggacaagggcttgagtggagtggggtggatcaggcgtctacgatgaataacatacgactttgcacgagaagttccgagggcaggagtctccagtgagctacagaccacatccacgacgcacagtacactagagtaactgaggagtactaggaacctagtacgtagaaccgtacgaccgggtacgttagttaattagttgtacggacggaaggtacggggtacaccgtagtcccgttagggtagggttcggttgggttacgtcgttgggtcggttaacgggg

SEQ ID NO: 107232 - DNA, 782 bp, Homo sapiens
  misc_feature: GYAE6OF01DNCEU.23.50.E06.1.454.CMB.1.raw
  modified_base (207)..(207): a, c, t, g, unknown or other
  misc_feature (207)..(207): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtcctccatcctccctgtcctgcgtctggtcggganccagacgtccacctatcacgttcggccggcgagtcgaggactaattaacaacttattacgccgtggtatcgtagacaacgaaaccgaagggtaaacgtaaccttaaacgtccttagtaactctagtggtacgtactacttacctaccgttttgactaacgtcgacgggtcctaccctatccgtacgtattccgacggtcggtaccgtaggtacgggtacgttacggtaggggaacgttaacgttactttacgtaacggttcctaaccgtaacccgtacgttaccgaacggtacccgtaaccggtacccgtacgacccgtaaccggtacccgttaaggaaaacgggtttacccggtttacgtaaacccgtttaaacgtttttaaccgttaaccgtttaacggttaaacgtaaaaacgggtttaaaccttaaaccggttaccgggtttaccccgtttacccccgttttaccgttaaccccggttttaccccgggtaacccgttaaccggggtaaccttaaacggtttacggtaaacgggttaacggtaaacccgtaaacggttaccggttaccgggg

SEQ ID NO: 107233 - DNA, 568 bp, Homo sapiens
  misc_feature: GYAE6OF01DN6ZL.23.50.E06.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (317)..(317): a, c, t, g, unknown or other
  misc_feature (317)..(317): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctggtggganccagagtcaccatcacttgccgggngagtcaggacaattaacaacttatttagcctggtatcagacaagaaaaccgaaggggaaacgtaacctaaactcctagatctaatggtncactcctatttcgactaatcgacgggtcctcccaatcctcgtattcgaggcggcgtaggtggatcgtgggagtagtatttcgagttctacacatcagcacgcctagcacgcctagaacgtcgttatactaactttacttactagtactaaaagttactaacgtacgttaccgtccccttttacgtacccgtttcccggcccgttacgggaacctaagtcggttaacggaggtaaccgaaacgtcgttacgg

SEQ ID NO: 107234 - DNA, 687 bp, Homo sapiens
  misc_feature: GYAE6OF01CVH65.23.50.E06.1.454.CMB.1.raw
  modified_base (227)..(227): a, c, t, g, unknown or other
  misc_feature (227)..(227): n is a, c, g, or t
  modified_base (350)..(350): a, c, t, g, unknown or other
  misc_feature (350)..(350): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctcctgtctgcgtctggtgggagccagagtcaccatcacttggccggngagtcaggacattaacaacttatttagcctggtatcagcaaggaaaaccagggaaacgtacctaaaacctcctagatctagtggtagcactccactttgctaatcgacgggcctcccaattcncgtacttcgagcggcaggtggattcggtgggagacgttactttcgacgttcctacacctactaccgacgactaccggccctggaccacggtccctaaggtaaccggtacggtttacggaaccttaaaccttttacgttaaaccgttacgttaacgtaaaaaacggttaccttaaaacggtacccggtttacccgtacccccccttttttaacggaaccccgtttttacccggggtaaccccggtttaccggggaaaacccgttaaaggtttaacccgggttaaagggttaacccggggttaaacccgtaaaacccggtaaacggtttaacccggggg

SEQ ID NO: 107235 - DNA, 587 bp, Homo sapiens
  misc_feature: GYAE6OF01AK7QR.23.50.E06.1.454.CMB.1.raw
  modified_base (401)..(401): a, c, t, g, unknown or other
  misc_feature (401)..(401): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtcgcccactcccaggttcaactggaacaatctggagctgaggtgaagaggcctggggcctcgagtgaaggtctcctgcaaggcttctggttacatctttaggaactatgctatcaactgggtgcgacgacggcccctaggacgaagggcttggagtggagtggggtgatcgagcgtctacgatgataacacagacttgcacaggtaacgttccgagggcagagtctcatgagcacagacacnctccacgagaccacagtaccacgatacgggaactggaggtagtacgtagacctatccgtagtaccggacaccgggtaccgtagttacttagtcggttaggacgggacgggtacgggggacctacggacgttcccggtaggttacggttggggttacggttggccgttcgggtacgggttaccgggg

SEQ ID NO: 107236 - DNA, 535 bp, Homo sapiens
  misc_feature: GYAE6OF01BTZ6A.23.50.E06.1.454.CMB.1.raw
  modified_base (385)..(385): a, c, t, g, unknown or other
  misc_feature (385)..(385): n is a, c, g, or t
  modified_base (445)..(445): a, c, t, g, unknown or other
  misc_feature (445)..(445): n is a, c, g, or t
  modified_base (480)..(480): a, c, t, g, unknown or other
  misc_feature (480)..(480): n is a, c, g, or t
  modified_base (527)..(527): a, c, t, g, unknown or other
  misc_feature (527)..(527): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatcctttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggagtggggtggatcaggcgtctacgatgataacacagactttgcacagtaagttccagggcagagtctccatgancacagacacactaccacgacgcaacagtactacatgaacgtgagggagtctagacatcgngaccggacgacggcgttgtaagtttagttggtcgnggaggaggggacacgatccgttgtacggttgggttggttgcgttggngttacggg

SEQ ID NO: 107237 - DNA, 562 bp, Homo sapiens
  misc_feature: GYAE6OF01BMHFO.23.50.E06.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggcctcccaggtatcagatgtgacatccagatcgacccagtcctccatccctcctgtctgcgtctggtggganccagngtccacatcacttggccggngagtcgaggacattaacaacttattagcctggtatcagcaagaaaccagggaaactacctaaactcctagatcgtaatgggtanctaatccgatttcgactatcgaacggctaccgattcncgtaatcgaagcgacaggtgaatcgtagggataggtatttcgacgttcacacgtatcacggcacgtcctgcagtcccagaacgtacgtnacttaacttnttataccgtataaaacggtntaacgtgtcccgttacccttagtacccggtttccggtacccgtacggtaacctaagtttcggacgttaacggtaacaaaccggtaagtcgg

SEQ ID NO: 107238 - DNA, 881 bp, Homo sapiens
  misc_feature: GYAE6OF01C4U0X.23.50.E06.1.454.CMB.1.raw
  modified_base (208)..(208): a, c, t, g, unknown or other
  misc_feature (208)..(208): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgaccctagtcctccatccctccctgtctgcgtctggtcggganccagacgtccaccagtcacgttcggccgggagtacgtcgaacggtaactaactttaaaaccgtaactttaattttaccggacccgttaggttaacgttccgtaacggtaaccgaaaaccggtaaaaacccggaaaacgggggtaaaaaccgttaaaccccgttaaaaacccgttacccgttacggtaaacttaccggttaaagtttcgggtacggtacctaaaccgtttcccgtaacgtttttaccgactaaacgttcggtaaaccggggtccttaccccgtaacgtttcccgtacgtacgtttaccgacgggacccgggtaacgtacggggttacgggtacgttacgggttacggggtaaggttaacggttacttttaccggaacggtttaccctaacccgtaaccctaacgtaccgacggtaaccctacgcccgttacgaccgtacgtacccgttaggaaaccggttacgtttacggaaccctttaacgtttaacgttaccgttaagtaacgttaaaaacgttaaccgttaaaccgtacccggtttaccgttccccccgttttaaacgtacccccgggttttaccgttaacccccgggtacggttaaacccgttaaggttaccggttaaacggttaccgggtaaacccgttaaaccggtacgttaccgggg

SEQ ID NO: 107239 - DNA, 785 bp, Homo sapiens
  misc_feature: GYAE6OF01AL7PK.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctcctgtctgcgtctggtgggagccagagtccaccatcacttggccgggcgagtcaggacaattaacaacttatttacgcctggtatcagcaagaaaccgaagggaaacgtaacctaaactccctagactactagtggtcgactactccctacttttcgacctaaagtccgacggggtccttaccccgtacttccgtcgtaactttccgacggtccggtacgtaggttcgggaagttcggtagggggtaacgtaacggttaacgttttaccgtaacggttacctaccgaaccccgttaacgtcccgtaaacgggtcccgtaaacggtccccgttacggacccgtaacggtaccccggttaacgggtaaacggttaccgggttttacgaacccgtttaaaccttttaaacgtttaaccgttacggttaaacctaaaaaggtttaactaaaacccgttacggtttacccgttaccccccgtttttaccgttaacccggttttcccccgggtaacccgttaccgggggtaaaccccttaaacgggttaaccgggttaacggtaaacccgggttaacccgtaaaaaccgggttaccgtttaacccggggg

SEQ ID NO: 107240 - DNA, 645 bp, Homo sapiens
  misc_feature: GYAE6OF01CYCVG.23.50.E06.1.454.CMB.1.raw
  modified_base (206)..(206): a, c, t, g, unknown or other
  misc_feature (206)..(206): n is a, c, g, or t
  modified_base (367)..(367): a, c, t, g, unknown or other
  misc_feature (367)..(367): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcattccttttcttggtggcggcagcaacaggtgcccactcccaggttcaactggaacatctggagctgaggtgaagnggcctgggcctcagtgaaggtctctgcaggcttcgtggttacagttcttaaggaacttatgtactatcgaacgtggtagcgacgacggtccctggacgaagggtcttggagtggagtggggtgatcgagcgtactagatagataacagtacgtcttgacanagtaacgtcgagggcagcgtctctatgagtacacgacgacactaactaccgacgacgacacgtagttaccacgtaacgtacggtaacgtgggtaaggtacgtacgtacgaactacgtaccgtacgggaaccgaccggtaccggtaccggttagttaagtttacggttcggacgggtacgggaaggtacggggtaaccctaacggttaccggttaccgtttaaggggttaggttcggggtttacggttcggacgggttcgggtacggttttacccgggg

SEQ ID NO: 107241 - DNA, 608 bp, Homo sapiens
  misc_feature: GYAE6OF01A71M5.23.50.E06.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtctccatccctccctgtctgcgtctggtggganccagngtccaccatcacttggccgggngagtcaggactataacaacttatttagcctaggtactcagcaagaaaccgagggaaacgtacctaaactcctgatctatggtgctatcctacttgactaatcacgggtcctcctactctcgtacttcgaggtcggagtagtggacgtcggtagggacgtaagtatttacacgttacctacctaacctactaccgacgacctacgtcccgtgaccacggtaccgtaggtaacgtacgttacgaacttaacctttagttaaccttagtaactaaaagtactaaacgtaccgttaccgtacccgtttacgttacccgttaccggtcccgtacggtaccgtaagttacggtaacggtaggtaactaaacggtacgtacgg

SEQ ID NO: 107242 - DNA, 540 bp, Homo sapiens
  misc_feature: GYAE6OF01ARYZK.23.50.E06.1.454.CMB.1.raw
  modified_base (364)..(364): a, c, t, g, unknown or other
  misc_feature (364)..(364): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
tcagacgcgagtatcacgaccggtgctcgatttagatctactgacaacacacaaggggacccaaaaaaccacacccctccttgggagaatcccctagatcacagctccgcaccatggactggacctggagcatccttttcttggtggcggcagcaacaggtgcccactcccaggttcaactggaacaatctggagctgaggtgaagaggccgtggggcctcgagtgaaggtctcctgcaaggcttctggttacatctttaggaactatgctatcaactgggtgcgacacggcccctggacaagggcttggaggtggagtggggtggagtcgagcgtctacgatgaataacacagtactttgcanagaagttccgagggcagtacgtctccgatcgagacacagaacacactccacgacgacacagtacacgataggaactggagngtcnganatcgagacgacgacgcgtgtattgtgtgcggaggacgggcacgtcgtccgttggtaggttgggttggttggcgttggtcggttacggg

SEQ ID NO: 107243 - DNA, 748 bp, Homo sapiens
  misc_feature: GYAE6OF01DFESS.23.50.E06.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (337)..(337): a, c, t, g, unknown or other
  misc_feature (337)..(337): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtcctccatccctccctgtctgcgtctggtgggacnccagacgtccacctatcacgttggccgggngagtcgaaggacattaaacaacttatttagcctaggtatcgagacaacggaaaccgaggggaaacttaacctaaactccgtagactcgtaagtgggtacnctacttacccgtactttacgacaacgttccgaacgggccttaccccaagttcctacggttaattccgaaggccgggatacgggtggacttacgggtaggggaagttaacggttactttacggaacgtttccctaaccaacccgtacttaccgaacgtcccgtacggccccgtttacggacctaacgggtaccccgttaagggtaaaacgtaccgggtttacgtaaccttaaaccgtttttaacgtaaccgttaacggttaaacgtaaaaacggtttaccttaaaacggtccggttttacccctacccccggtttttaacgtacccggtttttacccgggaaccccggttaacggtaaccgttaaagttcgggttaaacggtaccggtaaaccgtaaacgtcggttaacggg

SEQ ID NO: 107244 - DNA, 727 bp, Homo sapiens
  misc_feature: GYAE6OF01EJ93F.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtcgcccactcccgaggttcaactggaacaatctggagctggaggtgaaggaggccgtggggcctcgagtgaggtctccgtgcgtaaggtcttcgtggttacatttacgttaaggaacttagtcgcttaactacgtaacggttggggtcgaccgacgaccgggtacccccgtagggacgtaaggggtcttagggacggttgggtaggtgggggtagacgtcgaggtccgttacgtaacggtataacgtaactaacgaacgtaaggttactttacggaaccaacgtaaggtaaccggttaccggaagggacgtaaggtacgtccgtacagtcggacgaccaacgacgacacacgtaccgaagacgtacgaacgtacgtactaacgtagttacgggaacgtaggacggtacgtacgtacgtacctaacgttaccgtacggtaacccggtaaccgtaccgggtaccgttaggtttaacttggttaggacggagggtacgggacgggtactaccggtagttccggttaggttcgggttagggttggttacggtcgtgggtcggtttaccgggg

SEQ ID NO: 107245 - DNA, 587 bp, Homo sapiens
  misc_feature: GYAE6OF01AYMQC.23.50.E06.1.454.CMB.1.raw
  modified_base (427)..(427): a, c, t, g, unknown or other
  misc_feature (427)..(427): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctccaggtatcagatgtgacatccagatgacccagtctccatcctccctgtctgcgtctggtgggagccagagtccaccatccacgttcggccggggcgagtcgaggactaattaacaacttattagcctggtatcagcaagaaaccagggaaactacctaaactcctagatctatggtgctatcctactttgacaatcgacgggcctacccatctcgtattcacggtccggctaggtcggtagtccgtaggggagacgttatttcaagtctaccacatcagtcacgtcgtnacgtacgcctaggaaccgtacggttcgaccttaacgtttacgttaactgttaacaaaagttacctaacgttagttccctaccccgttttcgtacccgtttcccgggtaccctagggtaccctaagttacggtacgtaacggtaaccaaacggtacgtcgg

SEQ ID NO: 107246 - DNA, 541 bp, Homo sapiens
  misc_feature: GYAE6OF01BTN9R.23.50.E06.1.454.CMB.1.raw
  modified_base (306)..(306): a, c, t, g, unknown or other
  misc_feature (306)..(306): n is a, c, g, or t
  modified_base (452)..(452): a, c, t, g, unknown or other
  misc_feature (452)..(452): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagagtcaccatcacttggccgggcgagtcaggacacttaacaacttattagcctggtatcagcagaaaccagggaaactacctaaactcctgatctatggtncatcctacttcgacaatcgaggtctccatcctgacttcagtcgctagtgatcgtgggatagtattcagtctacactatcagcagccgtgcacgtccgtagaacgtacgttacgactaacttacgttacctagtaactaaaacggtntaaaccgtcggttacctaccccgtttcacggtttcccgcccgtagggaacctaagtcggtaacggtaaggtaccaaaggtacttacggg

SEQ ID NO: 107247 - DNA, 721 bp, Homo sapiens
  misc_feature: GYAE6OF01BLIYM.23.50.E06.1.454.CMB.1.raw
  modified_base (217)..(217): a, c, t, g, unknown or other
  misc_feature (217)..(217): n is a, c, g, or t
tcagacgcgagtatcacgaccggtgctcgatttagatctactgacaacacacaagggggcagaagtctctctcagtcaggacacagcatggacatggagggtccctgctcagctcctgggactcctgctgctctggctcccaggtatcagatgtgacatccagactcgacccagtcctccactccctccctggtcctgccgtcgtgggtcggggacnccgagtacgtccaccgtatccacgttcggaccgggtcgagtacgacggtactaagttaacaacttagtttacggccgttaggtactaccgaaggtaaccgaacggaaaaccgtaaacggggtaaaaccgtaacccttaaaaccgtcccgttaaggtacttacgttagtcgggtctacctactttaccgtacgtttcgaacctaagtaccggacggtccctacccgtgttaccgtacgtaacgtttcgacggtacggtactaggttcggtaacgtcggtagggtaacgtggtttaactttacggagttcctaaccaccgtataccgtaccgacgtcctgaccgcgtcgtacgtaagtcccgttagaacctaacgtttaactgttaaccgtaagtaaacggtataacggtccgttacccgttaacccgtttcgtaaccgtttacccggccgtaacgggtaactaggttacggtacgaaaccgggtttacaaccggttacgtacggg

SEQ ID NO: 107248 - DNA, 653 bp, Homo sapiens
  misc_feature: GYAE6OF01C466A.23.50.E06.1.454.CMB.1.raw
tcagacgcgagtatcacgaccggtgctcgatttagatctactgacaacacacaaggggacccaaaaccacacccctccttgggagaatcccctagatcacagctccgcaccatggactggacctggagcattccttttcgttggtggcggcagcaacaggtgcccactccaggttcaactggaacatcgtggagctggaggtgaaggaggccgtggggcctgaggtagaacggttctccgtgacgtaaggtcttcgtaggttacagtacttttaaggaacttagtagcttaataccaaagttggggtacgacgaacgaccgggacccctagggaacaacggggtctttaggagtgggtaagtcggggtaggatcgaggacgttgaacgtatagaactaacacaaggtactttgactaacgagacgttaccaggggctaggagttcctacagtgaagacgacgaacactaacacgacacgaacgacaacacggtactaacgtagtacggtaacgtagtaggacgtacgtagacctagtaccgaacgacgacgtacggtcttacgtagttacgttagaggacgaggtaacgggacacgtacgtacccgttgggaacgggttgggtacggttggtcggtcggtggttaacccgggg

SEQ ID NO: 107249 - DNA, 644 bp, Homo sapiens
  misc_feature: GYAE6OF01A7BLF.23.50.E06.1.454.CMB.1.raw
  modified_base (268)..(268): a, c, t, g, unknown or other
  misc_feature (268)..(268): n is a, c, g, or t
  modified_base (420)..(420): a, c, t, g, unknown or other
  misc_feature (420)..(420): n is a, c, g, or t
  modified_base (619)..(619): a, c, t, g, unknown or other
  misc_feature (619)..(619): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatcctttttctggtggcggcagcaacaggtgcccactcccaggttcaactggaacaatctggagctgaggtgaagaggccgtggggcctcgagtgaaggtctcctgcaaggtcttctggttacatcttttaggaactntgctatcaacgtgggtgcgacacggcccctggacgaagggtcttggagtgggagtgggggtagtatcgaggcgtcgtacgataggtaactaacgtacagttacttgacctaacgaggtaagttcccgagggtacaggtacgtctacagtganacgacagaccactacgtaccgaacgacgcaacgtagtaccgtacagtacggaaacgtgggaacggtagtaccgtagaaccgtagttaccggtacggtaccgaaccgtaccgggtcgttagttaacgtttagttcggtagggacggtaaggggacggtcctaacggtacttccgggtaggttagggttgggttgggttanacggttgggtcccgggtttaagggg

SEQ ID NO: 107250 - DNA, 596 bp, Homo sapiens
  misc_feature: GYAE6OF01BO9NB.23.50.E06.1.454.CMB.1.raw
  modified_base (537)..(537): a, c, t, g, unknown or other
  misc_feature (537)..(537): n is a, c, g, or t
tcagacgcgagtatcacgaccggtgctcgatttagatctactgacaacacacaaggggacccaaaaaaccacacccctccttgggagaatcccctagatcacagctccgcaccatggactggacctggagcatcctttttcttggtggcggcagcaacaggtgcccactcccaggttcaactggaacaatctggagctgaggtgaagaggcctggggcctcagtgaaggtctcctgcaaggcttcgtggttacattctttaggaactatgctatcaactgggtgcgacacggcccctggacgaagggcttggaggtgggagtgggggtggagtcgaggtcgtcgtacgatggaataacacagtactttgcacaagaacgttccgagggcagacgtctccagtgagcacagacacacgtaccaacgacgcaacacgtacctaacgagtacggaactggaaggtagtcgtagactactcgtacggaaccgacgaccgggtccgttagtaactttagttgtacggacggagggacggggnaaccgtcgtaccggttaggttaggttgggttgggttggtcgttgggtcggtttacgggg

SEQ ID NO: 107251 - DNA, 622 bp, Homo sapiens
  misc_feature: GYAE6OF01DKER7.23.50.E06.1.454.CMB.1.raw
  modified_base (228)..(228): a, c, t, g, unknown or other
  misc_feature (228)..(228): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctggtgggagccagagtcaccatcacttggccggngagtcaggacattaacaactatttagcctggtatcagcaagaaaccagggaaacgtacctaaactcctgatctatggtgcatcatttgcaatcgaggctccatctcgatcgagcgcagtgatcgtgggagagtatttcgagttctacaacgtctcgagcagtcctcgacacgtaccgtaggaaacgtacggtttacgaccgttaaacgtttactttaaccgtaaggttaacctaaaaaaaggtttaacttaaaccggtacggtttacccgttacccccgtttttaacgttacccggtttttccggggaaccccctttaagggggaaccccttaaaggttaacggttaaacggtaacggggttaaacctaaaaaccgggttacgtttaaccgggg

SEQ ID NO: 107252 - DNA, 554 bp, Homo sapiens
  misc_feature: GYAE6OF01DDSFP.23.50.E06.1.454.CMB.1.raw
  modified_base (287)..(287): a, c, t, g, unknown or other
  misc_feature (287)..(287): n is a, c, g, or t
  modified_base (338)..(338): a, c, t, g, unknown or other
  misc_feature (338)..(338): n is a, c, g, or t
  modified_base (431)..(431): a, c, t, g, unknown or other
  misc_feature (431)..(431): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcgagtgaaggtctcctgcaaggcttctggttacagtctttaggaactatgctatcaactgggtgcgacnggcccctggacaagggtcttggagtggagtggggtgatcgagcgtcacgtntgaataacacagtactttgcaacagtaagttccgagggcagtacgtctacatgagtcacagactacatacacgagcagagtacactagagacnggaagagtctagactagtcagacgaccgacgggcctagtattacgtgtcggagtagggacggctaacgtcgtaccggttgttaagggtcgggtttaggttgccggttggacggtttaccgggg

SEQ ID NO: 107253 - DNA, 844 bp, Homo sapiens
  misc_feature: GYAE6OF01APRFG.23.50.E06.1.454.CMB.1.raw
  modified_base (223)..(223): a, c, t, g, unknown or other
  misc_feature (223)..(223): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagtatgtgacatccagactcgaccctagtcctccacttcccctcccgtgtccgtgtccgttcgtgggtacgggacnccgagtacgtccaacctatcctacgttcgggcccgggagtacgtacgaacggtaacctaattaaacctaacgttagtttaacgccgttaggtactcgaacgtacgaaaccggtaaaaccggtaacgggtaaaaccttaacccgtaaaccgttccgtaggtaacttacgttagttcgggtactacgtaacgttcccgttaacgtttcggaacctaacggtccggaaccggtccctaccctacgttcctaccgtacttaccggacggtcggtaccgtagggtacggtacgtccggtagggaagtacgttacgttaccctagttacccgtacctaacccggtatacccggtaacgtcccgtacccggttaccgtaccgtaccggtaaccgttacccggtaaggttaaccggttaaccggttacggtaacctttaaacgttttacgttaaccgttaacggtaaacgttaaaacgttacgtaacccgttaccggtttaaccccgtttacccggtttaacccggttacccggtttaaccccggtaccggttaaccgggtaaaccgttaacggttaacgggtaaccggttaacccggtaaaccgttaaaccgggtacggttaccgggg

SEQ ID NO: 107254 - DNA, 922 bp, Homo sapiens
  misc_feature: GYAE6OF01DZB5C.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtcctccatccctcctgtctgcgtctggtgggacgccagacgtccaaccatcctacgttcggcccggggagtaacgtcgaacggaacctaacttaaaacctaaactttagtttaacgcccgttaggtaactccaacggtacaaacggaaaacccgaaggggtaaaaccgttaaccctaaaacgttcccgtagtaacttacgttaagttcgggtacgacctaacttaccctaactttcggacctaaacgttccggaacgggtccctacccgtattaccgtaccggtaactttccgaacggtcggtaacctaagggttacgggtaacgttccgggtaaggggtaacgtaacggtttaaccttttcggaacgtttaccctaccgaaacctaacgttccgtaacggtacctaaccggtcccgttaggaccccgtaagggtaccccgttaagggtaaaccggttaccggtttaaccgaaccgtttaaaacggtttttaacctttaaacccggttaacggtaaaaccggttaaaaaaacggtttaaccgttaaaacccggttacccgggttttaacccccttttaaccccccgggttttttaaaccgttaaccccggggtttttacccccgggggtaaccccccggtttaaacgggggtaaaaccccctttaaaaggggtttaaccggggtttaaaaccgggttaacccgggggtttaaaaccctaaaaaacccggggttacggtttaacccggggg

SEQ ID NO: 107255 - DNA, 636 bp, Homo sapiens
  misc_feature: GYAE6OF01BT3XT.23.50.E06.1.454.CMB.1.raw
  modified_base (203)..(203): a, c, t, g, unknown or other
  misc_feature (203)..(203): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatccctccctgtctgcgtctgtggganccagagtccaccatcacgttggccgggcgagtcaggacattaacaacttatttagccttggtatcagcaagaaaccgaagggaaacgtaacctaaactcctagatctatggtgcatcctactttgacactcagggtcctcccatccgtcgattcagcggcgagtggatcgtgggagagtattacgtagtctaccaccgtactcacgcacgacccgtgaccacgtaccgtagtaacgtacggttccgtaacgttaacctttatttaaccgtaacgttaaacgtaaaaacgttaacgttaaaccgtacgttacccgtttacccccttttaccgttaacccggttttacccggtcccccggttaccgggtaacccgtaaacgttacggttaacggtaaccgggtaaaccgtaaaaccggtaaccggtttaccgggg

SEQ ID NO: 107256 - DNA, 980 bp, Homo sapiens
  misc_feature: GYAE6OF01ETLC9.23.50.E06.1.454.CMB.1.raw
  modified_base (218)..(218): a, c, t, g, unknown or other
  misc_feature (218)..(218): n is a, c, g, or t
tcagacgcgagtatcacgaccggtgctcgatttagatctactgacaacacacaagggggcagaagtctctctcagtcaggacacagcatggacatggagggtccctgctcagctcctgggactcctgctgctctggctcccgaggtatcagatgtgactactccaggtatcgacctagtcctaccacgtcctcctgtcgtcgcgtcgtggtcgggacnccgagtacgtccaacctatccgtacgttcggaccgggtacgacgtaccggaaggtaacctaacgtttaaaacctaacgttaacgtttaccggccttagggttaacctacgaacggaaccgtaaaacgggtaaaaccggaaggggtaaaaaccgttaacccttaaaccgttaccgtaggtactttacgtaaggttggtacctaacgttcttaaccgttaacttcgaactaaggtcggtaccggtcctacccgtaagtccgttaacgtacgtttaccgacgggtcggtacgtagggtaccggttacggtacgggttacgggtaaagggttcgttacgttttacggtacgtttaccgtaaccctaccgttacgtaacccgtaacgggtaccccgacgtaccccgtccggtaaaccgtaacccggttaccgggtaaacgggttaaccccgggtttaccgttaaaccggttaacccttttaaacccggttttttaaacgttaaacccggttaaacggtttaaaacccgttaaaaaacggtttaacccgttaaacccgggtttaccccgggtttaaaccgtttttaaccccccccgggttttttaacccgtttaccccggggttttaaacccccgggggtttaaccccccgggttaacccggttaaaaacccggggtttaaacgttttaccgggggtaaaaacccgggttaaaaccccggggttaaaaacccgtttaaaacccggggttcggggtttaaaccccgggg

SEQ ID NO: 107257 - DNA, 949 bp, Homo sapiens
  misc_feature: GYAE6OF01D9EEZ.23.50.E06.1.454.CMB.1.raw
  modified_base (139)..(139): a, c, t, g, unknown or other
  misc_feature (139)..(139): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttntggtggcggcagcaacgaggtcgcccactcccgaggttacaacgtggaaacaatcgtgggacgtcgtaggaggtagaaggacggccggtggggtcctcgaggtacggtaacggttccttaccgtaggaccgtaagggtcctttacggtacggttaactacgtttacggtttaaacggtaacttagttcggtacttaactacggtaaacgggttcggggtacgaccggtaaccggaccgggtccccgtaaggggaaccgtaagggggtccgtttagggaacggggttacgggtaagggttgggggggttacgtaacgttaccggtaacgggttaccgttacgttaacgggtaaagttacggtaaaaccgttaaacctaacggttaacggtttaaccgtttaccgaacgaaaccggttaaacgggttaaaccggtttaccgggaaacgggggtactaacgggtacggttccctaaccggaggttaacggaccgaaccgtaacgtaaccggaaacctaccggaaccgttacccggaaaggtacgtaacccgtagtaacggttacccgtaactaacgggtaagggtaaaccgtgggaaacggtttaccgtacgtaacgaaccgttacggtacccgtaaccgggtaacccggtacggtaacccgggttcgtttaacgtttaaggtttcgggtacgggtagggtaaccggtacggggtaacgggtacctaaccggttaccggttacgggttagggttaacgggtttcggggtttacggtacggtcccgggttagggtacccggggttttaaccggg

SEQ ID NO: 107258 - DNA, 562 bp, Homo sapiens
  misc_feature: GYAE6OF01BLUYH.23.50.E06.1.454.CMB.1.raw
  modified_base (449)..(449): a, c, t, g, unknown or other
  misc_feature (449)..(449): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttcgtggttacatctttaggaactatgctatcaacgtgggtgcgacgacggcccctggacaagggcttggaggtggagtggggtggactcgagcgtctacgatgaataacacgagtactttgacacgaagtacgttccgaagggcaggacgtctcagtgagcacgagacacactccacgacgcacagtactacagtcggaactggaggngtcagactatcgtagacgaccgacggtacgttagttagttagttggtaggacggtagggagggccagtcgtcgtaggttcggtgggttacggttgcgttgggcggttaccggg

SEQ ID NO: 107259 - DNA, 612 bp, Homo sapiens
  misc_feature: GYAE6OF01BASSS.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggccttagtgaaggtctcctgcaaggcttctggttacatctttaggaactatgctatcaacgtgggtgcgacacggcccctggacgaagggtcttggaggtgggagttgggggtggagtcaggtcgtctacggatgataacacagtactttgcacagaacgttcagggcagagtctaccagtgagacacgagacacactaccacgagacacacgtactaacgagtacggaactggaaggtacgtcgtacgaactacgtcgtacggaccgaccgaccggtacgttagttagttaggttcggtggaccgggtaagggacggggtacctacgtacgttccgttagggttacggttaggggttcggtttcggtcgttcgggtggttacgggtttacccggggg

SEQ ID NO: 107260 - DNA, 712 bp, Homo sapiens
  misc_feature: GYAE6OF01BHTM8.23.50.E06.1.454.CMB.1.raw
  modified_base (203)..(203): a, c, t, g, unknown or other
  misc_feature (203)..(203): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccactcctccctgtctgcgtctgtggganccagacgtccaccatcacgttcggccgggcgagtcaggacattaacaacttatttagcctggtatcagcaagaaaccgagggaaacgtaacctaaactcctagatactagtggtgctactcctactttgacaatcgagggtcctccctactcgtcgtacttcgacggtcggacgaggttcggtagttcggtaggggaacgtaggtacgttttaccgtaacggttcctaaccgtaaccctagttaccgaacggtccgtaaccggtcccgttacggcccgaacgtaccccggttacggaaaccggttaccggtttacggaacctttaaaccgttttaactttaaccgttaacggttaaacctaaaaagttaacgtaaaccgttacggttacccgtttacccccgtttaccgtttaacccgttttacccgggtccccggttaacgggtaaacccgttaaacggttacggttaacggtaacggttaaccgtaaaaccggtacgttaaccgggg

SEQ ID NO: 107261 - DNA, 605 bp, Homo sapiens
  misc_feature: GYAE6OF01BP6I9.23.50.E06.1.454.CMB.1.raw
  modified_base (220)..(220): a, c, t, g, unknown or other
  misc_feature (220)..(220): n is a, c, g, or t
  modified_base (287)..(287): a, c, t, g, unknown or other
  misc_feature (287)..(287): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcattccttttcttggtggcggcagcaacaggtgcccactcccaggttcaactggaacaatctggagctgaggtgaagaggcctggggcctnagtgaaggtctcgtgcaaggtcttcgtggttacattctttaggaactatgtctatcaacgtgggtgngacgacggcccctggacagggcttgagtggagtgggtgatcgagcgtgtacgatgaataaacagacgtaactttgcgtaacaggtaacttccggaagggtctaggactcgtccatacgagcacagactacactacacgagcaacacgtactaacgactagggaactaggacggtagacgtacgacgtacgttcgtaacggtacgtaacgacggtacccgttgtaacttagtacggttcggaaccggtagggcggtactacggtattcccggtagttaacgggttgggttacggttggtcgttgggtcggttaacgggg

SEQ ID NO: 107262 - DNA, 677 bp, Homo sapiens
  misc_feature: GYAE6OF01A87UW.23.50.E06.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (318)..(318): a, c, t, g, unknown or other
  misc_feature (318)..(318): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatccctcctgtctgcgtctgtggganccagngtcaccatcacttgccgggnagtcaggactattaaacacttattcgcctaggtatcgagacaacgaaaccgaggtaaactaacctaaactctagtatacgtagtgggtacnctactccttatttcgactacgtccgacggtcctacctaacttcgtacgtaacttcgacggccggtacgtaggtcgtaacgttcgggtagggtagtacgttacgtttacgtactccgtacctaacctacgtacgacgaccgtacgtccgtccgacgtaccggtaccgttaaggaaccgttacggttaccgaaccgtttaaacgttttaacttaaccgttaacggttaaactaaaaacggtttaccgtaaaccggttaccgtttaccgtttacccctttaccggttacccgtttacccgggtaccccggttacgtaacctaggttacgtaacggtacgtaaacgtaaaccgtgttaacggg

SEQ ID NO: 107263 - DNA, 764 bp, Homo sapiens
  misc_feature: GYAE6OF01ACK0M.23.50.E06.1.454.CMB.1.raw
  modified_base (229)..(229): a, c, t, g, unknown or other
  misc_feature (229)..(229): n is a, c, g, or t
  modified_base (276)..(276): a, c, t, g, unknown or other
  misc_feature (276)..(276): n is a, c, g, or t
  modified_base (455)..(455): a, c, t, g, unknown or other
  misc_feature (455)..(455): n is a, c, g, or t
  modified_base (607)..(607): a, c, t, g, unknown or other
  misc_feature (607)..(607): n is a, c, g, or t
tcagacgcgagtatcacgaccggtgctcgatttagatctactgacaacacacaaggggcagaagtctctctcagtcaggacacagcatggacatgagggtccctgctcagctcctaggggactcctgcctgccttctgggcctacccgtaggtattccgagtatcgttcgactactcccaagattaccggaacctagttccctcctacgtcccctttaccctgtccgtnccggtttcgtaaggccgggggtactacccgagttacgtcccaaaccncttcggtacgttcgggccggggtcgacgttacgaacggtataaccgttaactaacgtttatttcggacccgttggtacgttaccagacgtaacgaaacccggtaacgggaaacgttacctaaaccgttctacgtagtaccttaaggtgggtaaccctacaccgttacctaaccggtttnaacctttagccggttacggacccttcctaagtcctaacgtagtaccctgggaacgcgtttaccggaggtcgttacggtagggtacgtacggttacgttacgttaacgtcgtacccttagaaccttacgactcgtaactccgtactaacggtntacccgtagtacggttaacggtacgtctttaaacgtacgtttacttaaccgtacgttaaacgtacgtaactcgttacgttaacccgtttctcccgttacggtacgtacccgtacgttaacgtcggtacgtaacgtaccgtaaacggtcgttaaccgg

SEQ ID NO: 107264 - DNA, 631 bp, Homo sapiens
  misc_feature: GYAE6OF01BD3X0.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggccgtgggcctcgagtgaaggtctcctgcaaggcttcgtggttacagttctttaaggaacttatgctatacaacgtgggtgcgacacggcccctggacgaagggtcttggaggtggagtggggtgagtcgaggtcgtacgtacgagtagaataacgacgtagtactttgacaacgtagtaacgttccgaggcgtaagtacgtccgtaccagtacgacgtacgacacgaaccacgaacctacccaacccggacgtacgaacgacgttacctaacgtaagtacggtaaactggaacggtagttcctagactaatccgtacgaccgacgtacggtcgtagttagttagttggtacgacggtagggtacggacacgtcgtacccgtggtacgggttcgggttaggttgtcgtcgggtcgttaccgggg

SEQ ID NO: 107265 - DNA, 742 bp, Homo sapiens
  misc_feature: GYAE6OF01BWTOE.23.50.E06.1.454.CMB.1.raw
  modified_base (207)..(207): a, c, t, g, unknown or other
  misc_feature (207)..(207): n is a, c, g, or t
tcagacgcgagtatcacgaccggtgctcgatttagatctactgacaacacacaagggggcagaagtctctctcagtcaggacacagcatggacatggagggtccctgctcagctctgggactcctgctgctctggctcccaggtatcagatgtcgacatccagatcgacccagtcctccactcctcctgtcgtgcgtgtggtggacncagagtccacactctacgtggcccgggtgacgtcgaggtactaacttaaactaacttattacgtcccgtaggtactacgaagacgaaacggaaaccggtaaacggggtaaaacgttaaccccgttaaaaccgttccgtaacggtaactttaccgttaggttacgggttacgtacctaccttacccgttaacgtttccggaacctaacgtaccggtaacgggtcccccttaccggtaaccttcgtacgtacgtcgacgggtaccggaccgtagggtcggtacgttcggtagggactagtacgtttcacgtcctacgacctatccgatacgcgtcctcgaccgagtaccgtaggaacgtaccggttactaacgtttaaccttaagttaccgttaagtaaacgttaaacggtaactaaccgtcccgttaacccgtttccccgtttacgttaccggttaccccggttacggtaccggtaaacttacgggttaacgtaacgggtaaaccgttaaacccggtaaccgggtacggtaccggg

SEQ ID NO: 107266 - DNA, 669 bp, Homo sapiens
  misc_feature: GYAE6OF01C1JC3.23.50.E06.1.454.CMB.1.raw
  modified_base (257)..(257): a, c, t, g, unknown or other
  misc_feature (257)..(257): n is a, c, g, or t
tcagacgcgagtatcacgaccggtgctcgatttagatctactgacaacacacaaggggacccaaaaccacaccctccttgggagaatcccctagatcaacagctccgcaccatggactggacctggagcatcctttctggtggcggcagcaacaggtgcccactcccaggttcaactggaacaatctggagctggaggtgaaggacggccgtggggcctcgaggtgaaggtctcctgacaaggcttcgtggttaacngtacgtttaggaactatcgctatcaagtggtgcgacgtacggccctaggacgaaggcgttaggagtggagtggggacgagtcaggcgtacgtacgagtgaactaacactacgtactttcgactaacgacgtaacgttaccgaggtaccgagacgtacgtacgtaagtaggaacgtcaacgaacgactaacgtacgtacccgtaacgacgaacgaaccgtacgttacgtaacgtaaggtacggtaaaccgtagggtaacggtacggtacgacggtaaacctacgttacgtacggtaaccgtacggaccggttacgtagttaccgttagttcggtggacggtaggaacggggtcaacgttacgtccggttaggtgggttacgggtaggttacggcgttggtcggtttaccgggg

SEQ ID NO: 107267 - DNA, 592 bp, Homo sapiens
  misc_feature: GYAE6OF01A089C.23.50.E06.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
  modified_base (531)..(531): a, c, t, g, unknown or other
  misc_feature (531)..(531): n is a, c, g, or t
tcagacgcgagtatcacgaccggtgctcgatttagatctactgacaacacacaaggggacccaaaaaccacacccctcttgggagaatcccctagatcacagctccgcaccatggactggacctggagcatccttttcttggtggcggcagcaacaggtgcccactcccaggttcaacgtggaacatctgganctgagtgaagngcgngggcctnagtgagtctcngcagcttgtgtacatcgttagactntnctancagtggtgcgacacgccgngacgaggctagaggtggtaggtggggtgagtcgacggtcgtactacgagtacgaagtaacgactacgtacttgacgtaagaacgtaacgtcggaaggacgacgtacgtactacgagtacgacgaccagaacgaccncaactcgaagaccncgaatacgactacgtaagtaggtaacgtagacggtcgtacgtagtaactacgtacgacgtaccgacgtcggtaccgttagttacgtgtagtacggagggaacggnggtaccgacgtaccgttcgttagttagggttggttaggtacggtgtgggttcggttacggg

SEQ ID NO: 107268 - DNA, 702 bp, Homo sapiens
  misc_feature: GYAE6OF01AWL71.23.50.E06.1.454.CMB.1.raw
  modified_base (129)..(129): a, c, t, g, unknown or other
  misc_feature (129)..(129): n is a, c, g, or t
  modified_base (160)..(160): a, c, t, g, unknown or other
  misc_feature (160)..(160): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
tcagacgcgagtatcacgaccggtgctcgatttagatctactgacaacacacaaggggacccaaaaaccacacccctccttgggagaactcccctagatcacagctccgcaccatggactgacctggancattcctttcatgggtggcggcgagcaacgnggtcgaccccactcccgtaggttaccaacgtggaaccaatccgtggacgctggaggtagaggcggtccgtgggcctgaggtgacgtcncgtncgaggtcttgtgtactagttacgttagactgtctctactactaggtggtacnccgacgccggcccgtaggaacgtacgggtcgtagggtacgggtaggtgggtacggggtgtacgtcgtacgggtacgtacgttagacgttacgaaacctaacgtacgtaacgttacgttagaaccgtaacggtaacggtacggtaccggaaggtacacggttaccgtacgtacgtacgtacggaccgacgaaccgacgtaccaacctaacgtacccgacgaacgaccaacgtaacgttaccgtaacgtacggtaacgcggaagtacggtacgtacgacgtactacgaggtaacgaccgtaccggtacgtacgtattcgtaggtacgtagggacggtacgggacgtacgtcgttacgtggttaacggttggtccgttgggtacgtgggtccggttacggg

SEQ ID NO: 107269 - DNA, 777 bp, Homo sapiens
  misc_feature: GYAE6OF01DORA7.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcgttggtggcggacagcaacgaggtcgcccacctccgaggttacaactggaaacaatcgtggagcgtgaggtagaagcggccgtggggctcaggtgaaggtctccgtgacaaggtcttcgtagttacagttcgtttaggaactagtcgtacgtactacgtaacggtgggacggcgacgtaccgggacccttacgggaacgaaggggttccgttaggaaggtcgggtaggtgggggtacgtagtacgaggtacgttacgtacgtagttacggaacttaaaccgacgaacggttactttcgaacgtaaacgtaacggtaaacggttcccgaaggggacctagtacggtcctaacgtagactacggacaaccgaacggtaccaacacgttaccaaacggatacccgaacgtaccggtacctaacggtaactaccggggaacgtaacgggtaacgtaacggtacgtaacgtaacccggtattcggaaccggtaacccggtaacgccggggttaaccttagggttaacttagggtttacccgaggggtacgaacggggtacggaccgttaacgaacgttttccgggaagtttaacgggggtcgggttacggttagggtccgttaagggtcccggtttacggggg

SEQ ID NO: 107270 - DNA, 672 bp, Homo sapiens
  misc_feature: GYAE6OF01B4P78.23.50.E06.1.454.CMB.1.raw
  modified_base (204)..(204): a, c, t, g, unknown or other
  misc_feature (204)..(204): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctggtgggacnccagagtccaccatcacgttcgccgggcgagtcaggacaattaaacaacttatttacgcctggtatcagcaagaaaccgaaggaacgtaacctaaacctcctagatctatggtgcactcctactttcgactaatcgaacgggtccctaccctactccgtacgtaattccgaagggtccggaccgtaagggtggtaacgttcggtagggggtaagtacggttacttttaccgacgtttaccctactaacccgactttaccgaacggtccgtaacgtcccgtagaccgtacgaccgttaaggaaccggttaacgttcgaacctttaactttaacttaacgttacgttaaactaaaacgttattaaaccgtacgttcccgttacccgtttcgttacccgtttacccgggtcccgttacgggtaaccttaaagttggtaaccggagttaacccgtaaaggtaccgttacggg

SEQ ID NO: 107271 - DNA, 639 bp, Homo sapiens
  misc_feature: GYAE6OF01CA7AE.23.50.E06.1.454.CMB.1.raw
  modified_base (194)..(194): a, c, t, g, unknown or other
  misc_feature (194)..(194): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctgganctggaggtgaagaggccgtggggcctcagtgaaggtctcctgacaaggtccttcgtggttacattctttaaggactatgctatcaacgtggtgcgacacggcccctggacgaaggcttgagtggngtcggggtgatcgagcgtatacgntagataacacgagtcttagcacgtagacgtcgagggtacagtctactcagtagagcaacgtagacacgactacgagaacgtcaaacgtacgtctaacgtaacgtacggtaaccttgggaaacggtacggttaccttaacgggaacctacgtttacgtaaccgggacccgtaaccgggaacccggttaaccgttaggtttaaacccgttagtttacggggtacgacgggtaagggtccgggaactacggtcttacgtaggtcggttagggtcgtggcgtcgggtacggttaccgggg

SEQ ID NO: 107272 - DNA, 745 bp, Homo sapiens
  misc_feature: GYAE6OF01CWXPQ.23.50.E06.1.454.CMB.1.raw
  modified_base (151)..(151): a, c, t, g, unknown or other
  misc_feature (151)..(151): n is a, c, g, or t
  modified_base (159)..(159): a, c, t, g, unknown or other
  misc_feature (159)..(159): n is a, c, g, or t
  modified_base (291)..(291): a, c, t, g, unknown or other
  misc_feature (291)..(291): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcattccttttgttggtggcggnagcaacgnggtcgcccactccctaggttacaacgtaggaacaagtcgtggagcgtaggaggtagaaggcggccgtggggcctgaggtagaaggttcctccgtgacacggtcttcgtgttaacattacgttaagactagtntactataccgaaggtgggacgacgaccgaccgggtacccgtaggaacgtagggtcttagggaggtgggtaggtggggtagtaacgtcggaggtccgtaacggtaacgagtaacgaaacgtaaccgagttaacgtacgttacgacgaacgtaaggttaacgtcggaagggtactaaggtacctctaacgaagtacggaaccacaacgaacgtaccacgtaccgaaccgaggaacaactaacgtaacggactaacgtagtaacggaattaggacgtacgttacgtagtactaacgttcggaacggtaaccgaaccgggttacgtaacggtttattaacggtttgttacgggacggtaaccgggagggtaacccgggataaccgtttcgggtaaccggttggttaagggtttgggttaaccgggtaggttacggttggtaacggggtttacccgggg

SEQ ID NO: 107273 - DNA, 858 bp, Homo sapiens
  misc_feature: GYAE6OF01CW8Q9.23.50.E06.1.454.CMB.1.raw
  modified_base (614)..(614): a, c, t, g, unknown or other
  misc_feature (614)..(614): n is a, c, g, or t
tcagacgcgagtatcacgaccggtgctcgatttagatctactgacaacacacaagggggcagaagtctctctcagtcaggacacagcatggacatgagggtccctgctcagctccgtgggactcctgctgctctggcctacccgaggtatcagtatgtacgacactccgagtactacggaccctagtcctccactccctcctgtcctgcgtacgtggtcgggacaccaggtactccaacctacttccgacggttccggggacccggggaggtacgtacgaacggtactaactttaaaacctaacgtttaacgtttacggtacccgttaagggttaactacgtacgaaaccggaaaccggtaaaaccggtaaaccggggtaaaacctttaaccccgtaaaaccttaccccgttaaggttaacttacgttaacggttagggttaccgacccttaaacttacccttaaccgttttacgaaccgtaaacgtaccggtaacccgggttaccctaacccgtacgtttacgttaccgtacgttaccggaacggcggtacgtaaggttacgtacgtacggtagggacgtagtttacgtacgtacgtccgtaccaacgttacnccgtacgtaccggtacctccggacgtacccgtacggtaacccgttaagggaaccggttttaccggtaaacttacgttaaacctttacggttaacgttaaactaacggtttaaaacgtacttaaccggttaccggttacccctttcccctttaaccgggttaccgttaccccgggtacccgttaaccggtaacttaaggttaaccgggtaaacggttaccgtaaacggtaccgggttaagtccgg

SEQ ID NO: 107274 - DNA, 697 bp, Homo sapiens
  misc_feature: GYAE6OF01DCEHR.23.50.E06.1.454.CMB.1.raw
  modified_base (361)..(361): a, c, t, g, unknown or other
  misc_feature (361)..(361): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaaggaggccgtggggcctgagtgaggtctctgcaaggcttctggtacatctttagactatgctatcaacgtgggtcgacgacgacggcccctaggacgaagggtcttaggagtgggaggtggggtaggactgacgcgttcgtacgagtgaataaccganagtacttgactacaaggtaacgtccgaggacgtagtaacgtcctacgataggacgacaacgaagaccaacgacgtaccgaacgagtacaacgtagtaacctacgaacggttacgggtaactaggtaagggtacgttacgtacggaacttaacgttaccggtaacgaacggaacccgtacccgggttaccggttacggtttaaagtttcgttacgggagggtaccggaacgggggaacggggtacctaaccggttacggttacccggttagggttaacgggtttccgggggttaggtttacggaccggggttttggcccggggttttaaccgggggg

SEQ ID NO: 107275 - DNA, 881 bp, Homo sapiens
  misc_feature: GYAE6OF01B87OB.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctccgtgggactcctgctgctctggcctccgaggtatcagatgtagacataccagactcgaccctagtcctcctactccctccctcgttcctcggtccgttcgtcgggtcggtacaccgaggaaccgtccacctactacgtccgttcggggacccggggacggtaacgtcgaacgggtaaacctaactttaaaacctaaacgtttaactttaccggtacccgttaggtaactaccgaacgtaccggaaaacgggaaaacccggaaagggggttaaacccttaaacccgttaaacctccgttaagtctaacgttagtcggtacgtctacctaccgttactaggtactacgttacgaccgggtccctcccgttactcggtacgtacttacggaccggtacggtacgtacgggtcggttacgttagggtaacgggaagttaaggttacgtttaccgttaacggtccctaacccggtacctaacggtccgactaccggtaaccggttccaggtacccgtaccggtaacgttaacggtcgttaacccgggttattaaaccgtttaccggttaaacctttaacgggttaaccttaaaacggttaaacgtaaccggtttaaccttcccgggtttaacccctttacccggtttaacccgtttaccccgggtttaaccccggggtccccgttaaaacggggttaaccccgttaggggtttaaacccggttaacggtaaacccgggtttaaacgaaacccggtttaacccgggttagggg

SEQ ID NO: 107276 - DNA, 831 bp, Homo sapiens
  misc_feature: GYAE6OF01DH1HS.23.50.E06.1.454.CMB.1.raw
  modified_base (154)..(154): a, c, t, g, unknown or other
  misc_feature (154)..(154): n is a, c, g, or t
tcagacgcgagtatcacgaccggtgctcgatttagatctactgacaacacacaagggggcagaagtctctctcagtcaggacacagcatggacatggagggtccctgctcagctctgggactcctgctgctctggctcccaggtatcagatgtnacatccagatcgaccctagtcctccatccctcctgtcctggcctgtggtcggacgcctaggtacgtccaccgtatccgtacgttcgggccggggatacggtcgaaaggtactaacttaacaaccttatttacggaccttggtaactccaggactaaacggtaaaccgaaggggtaaaacctaaccgtaaaacctccgtaagtactacctagttacgggagtacctaactacccgtaactttacggaccttaaacgttaccggtaccggggtacccttaaccccgtaacgtttaccgtacggttaaccgttccggaacgggtacccgggtaacggttaaacgggttacgggaacgtttacggtacgggggtaacgttaaggttacttttaacgggacgtttacctaccgtaaacctcgttaacgtacgaacccgaacggtcccttaccggacgtaacccgggtactacgggttaaaacggtccggtttaaccgtaaccgttaacggtttaacttaacccgttaacgtaacccgtaaaaaggttaccgttaaaccgtaccgttaccggtttccccctttaaggttaaccccggtttacccggtcgggttaaacccggaaccgtaaaggtttccgggtaaacgttagggttaaaccgaaaacccggtttcggtaaccggg

SEQ ID NO: 107277 - DNA, 751 bp, Homo sapiens
  misc_feature: GYAE6OF01BEMP3.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccagtatcagatgtgacatccagatgacccagtcctccactccctccctgtctgcgtctggtgggagccagacgtccaccatctacgttcggccgggacgacgtcgaaggactaacttaaactaacttaatttacgccgttaggtactcgaagacgaacgaaaaccggaacggggtaaaacgttaacctaaaccttccgtagtacttaccgttagtggtacactaacttacctacgtttgactaacgtcgtacgggtcctcccgtattcctacgtacttcgacggtcggacgtaggttcggacgttggtacgggtagtacgtttacgtttaccgtacgttaccgaccctaactaccgtaccgtacgtaccgaccggtcccgtaggtaccgtaccggaccgttaacgggtaaccggttaaccgttacggtaacctttaaacgttttacttaaaccgttaacggtaaacctaaaacgtttaacgtaaaccgttaccggttacccgtttacccccgtttacgttacccggtttccccggtaacccggttacggtaaacccgttaacggtttacggtaaacgggttaacgtaaccggtaaaccgttaacggtacggg

SEQ ID NO: 107278 - DNA, 671 bp, Homo sapiens
  misc_feature: GYAE6OF01CGOSW.23.50.E06.1.454.CMB.1.raw
  modified_base (224)..(224): a, c, t, g, unknown or other
  misc_feature (224)..(224): n is a, c, g, or t
  modified_base (608)..(608): a, c, t, g, unknown or other
  misc_feature (608)..(608): n is a, c, g, or t
tcagacgcgagtatcacgaccggtgctcgatttagatctactgacaacacacaaggggacccaaaaaccacaccctccttgggagaactcccctagatcacagctccgcaccatggactggacctggagcattccttttcgtggtggcggcagcaacaggtcgcccactccaggttcaacgtggaacaatcgtggagctgaggtgaagacggccgtggggcctnacggtgaacggtcctccgtgacgaaggtcttacgtggttaactattaccgtttaaggaactagtcggacttagtcgaacggtgggtacgacgtacgacggtcccgtaggaccgaagggtcttaggaagtggagtgggtagtactacgacggcgtacgtaagagtacgaacgtaaccaggtacgttacgttcgactacgaggtaacgtaccggaggtccgtaagtaccgtcgtaaccgagtcggacgacaacgacggacaacacgtaccgacgtacgacaacgtacgtactaacgacgtaggaaacgtggaacggtgtacgacgtacagtcggtacgacgacgacggttcgtagttatcggtacgtcggagtaacggcgggtacnccggtacgttcgttaacggtacgggttaggttcggtacggcgttacgggtcggtttaacgggg

SEQ ID NO: 107279 - DNA, 765 bp, Homo sapiens
  misc_feature: GYAE6OF01A6IC2.23.50.E06.1.454.CMB.1.raw
  modified_base (162)..(162): a, c, t, g, unknown or other
  misc_feature (162)..(162): n is a, c, g, or t
  modified_base (239)..(239): a, c, t, g, unknown or other
  misc_feature (239)..(239): n is a, c, g, or t
  modified_base (584)..(584): a, c, t, g, unknown or other
  misc_feature (584)..(584): n is a, c, g, or t
  modified_base (634)..(634): a, c, t, g, unknown or other
  misc_feature (634)..(634): n is a, c, g, or t
tcagacgcgagtatcacgaccggtgctcgatttagatctactgacaacacacaagggggcagaagtctctctcagtcaggacacagcatggacatggagggtccctgctacagctccgtgggactcctgctgctcgtcggcctccgaggtatcagtatcgtnactatccagacgtcgaaccctgttccctacctaccttccccggtccttgttccgtcgtcgtccgtagggtcgggacnccgtaggactccaacgtctcgtacggttcggaccgggtcgagtcgacgtaactacttaaacgtaccttagttaccgtccggtagtataccgaagaccgaaacggaaaccggtaacggtaaccttaacccgtaactaccgttaggacttacgtacgttcggtaccgtactaaccgttcccgttaacgttaccgtaacgtaaccgtaacccggtaccggggtaccccttaaccccgactttacccggggtttaacgtaccgtttaaccggaccgggtaaccggtaccgggttaagttaccgggtaccgggttacggtacggggaaggttacgtttacggttaccgtnttaacccgtcgtaactaccggtacgtaacggccttacgctaccggtaacncgttacccgagttacgtacgtctaacgtaccttacgtacttagaaacttacggaactacgtaccgttccttacccgttatcccgttacggacgttacgacgttaatccggtaggaccacgacttcggtacg

SEQ ID NO: 107280 - DNA, 778 bp, Homo sapiens
  misc_feature: GYAE6OF01D1YT6.23.50.E06.1.454.CMB.1.raw
tcagacgcgagtatcacgaccggtgctcgatttagatctactgacaacacacaagggacccaaaaccacacccctcttgggagaatccctagatcacagctccgcaccatggactggacctggagcattcctttttcgttggtggcggcagcaacaggtcgcccacctcccgtaggttcaacgtggaaacaatcgtggagcgtggaggtgaagacggccgtggggcctcgagtgacggtctccgtgcgaaggtcttcgttaggttactattacgtttaaggaacttagtcgtacttaacgtacgtaacggttggggtacggtaccggaccgtacccgggtaccccggtagggaaccggtaacggggtcgtttacgggaagggttggggtagggttggggggtaggtacgtggacggtaccggttacgtacgaagtagtaaactaaacgaacgtacgtacgtttcgacctaaagtacggtaacgtaccggagggacgacgtacgtacctacgaagtgaacgtaccgaacgaacgaaccaacgtaccgtacccgaacggacaccgtaacgtaacgtactaacgagtacgggtaacgtagggaacggtacgtcgtacgtaacgtacgtcgtaacggaaccgtaccggtacggtacgttgttaacgtttggtggtacgggaacggacgggtacgggtaccacggttacggttcccggtttagggttacgggtttacgggtttacggggttcttaccgggttggtaccggggtttaaccgggg

SEQ ID NO: 107281 - DNA, 810 bp, Homo sapiens
  misc_feature: GYAE6OF01BUB38.23.50.E06.1.454.CMB.1.raw
tcagacgcgagtatcacgaccggtgctcgatttagatctactgacaacacacaaggggacccaaaaaccacacccctccttgggagaactcccctagactcacagctccgcaccagtggactggacctggacgcattcctttttcgtgggtcggcggcagccaacgacggtcgaccctactccccgtaagggtttacaaacgttagggaaactaacgttccgtaggacgtcgttacggagggttacggaaacggcgggtcccggtcgggggtacccttacggtaggttacggtaacgggttcccttaccggtcggacggtaacgggtccttttcggttacggttaacctaacgtttacggtttaacggaacttagtacgtacgttacgtacggtacggtcgggtaccgaccggtacggtccggtaccgtaggtaacggtacgggtcgttaggtacggtagggtaggtcgggtacgtacgtacgtacggtcgtacgtacgtagtaacgtactaacgtacggtacgttacgtacgaccgtaacggtacgtacggtacggacggtacgtacgtacgtctaacggtacgtacggactaaccgacgtacgaacctaacgtaccgtaacgaccgtaacgtaccgtacgtacgtacgtaagtacggtacggtacgtacggtacggtacgtacgtacgacgtacggtaccgtacgtacgtacggtacgtacgttagtacgttacggcgtagggaccggtacggtcgtacgtagtcggttcgtaggtcgttcggtacgtcggtacgtgggtcggtccgg

SEQ ID NO: 107282 - DNA, 511 bp, Homo sapiens
  misc_feature: GYAE6OF02F9QZ2.23.50.E06.1.454.CMB.1.raw
  modified_base (467)..(467): a, c, t, g, unknown or other
  misc_feature (467)..(467): n is a, c, g, or t
  modified_base (503)..(503): a, c, t, g, unknown or other
  misc_feature (503)..(503): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtggatcagcgtctacgatgataacacagactttgcacagaagttccagggcagagtctccatgagcacagacacatccacgagcacagtctacatggaactgaggagtctgacatctagacgacacggccgtagtagttattgtgcgaggnggggcacgatccgtgtaggtggttaggttgcgttgngttacggg

SEQ ID NO: 107283 - DNA, 489 bp, Homo sapiens
  misc_feature: GYAE6OF02F54YP.23.50.E06.1.454.CMB.1.raw
  modified_base (358)..(358): a, c, t, g, unknown or other
  misc_feature (358)..(358): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagagtcaccatcacttgccgggcgagtcaggacattaacaactatttagcctggtatcagcagaaaccagggaaagtacctaaactcctgatctatggtgcatccactttgcaatcaggctcccatctcgattcagcggcagtggatctggganagatttcagtctcaccatcagcagcctgcagcctgaagacgttgactaacttattactgtacaaaagtataacagtcgacccctttcacctttcggcccttgggacctagtcgtagaggtacaacgactgg

SEQ ID NO: 107284 - DNA, 503 bp, Homo sapiens
  misc_feature: GYAE6OF02F85TO.23.50.E06.1.454.CMB.1.raw
  modified_base (427)..(427): a, c, t, g, unknown or other
  misc_feature (427)..(427): n is a, c, g, or t
  modified_base (465)..(465): a, c, t, g, unknown or other
  misc_feature (465)..(465): n is a, c, g, or t
  modified_base (498)..(498): a, c, t, g, unknown or other
  misc_feature (498)..(498): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtggatcagcgtctacgatgataacacagactttgcacagaagttccagggcagagtctccatgagcacagacacatccacgagcacagtctaacatggaactgaggagtcngacatctgacgacacggccgtgtattattgtgcgaggnggggcacgatccgtgtagtggtggttgcgtggngtagg

SEQ ID NO: 107285 - DNA, 532 bp, Homo sapiens
  misc_feature: GYAE6OF02H2OKT.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatccctccctgtctgcgtctgtgggagccagagtcaccatcacttgccgggcgagtcaggacattaacaactattagcctggtatcagcagaaaccagggaaagtacctaaactcctgatctatggtgcatccactttgcaatcagggcctccatctacgtattcagcggacagtggatcgtgggagagtattcagtctcaccatcagtcacgcccgcacgcctagagtacgttgacaactttattactacgttaacaaaagtataatacgtaccgtaccccttttacgacctttccggacccgtagggtacctaagttaggtacgaacggttaccaaaacggtacgttggtacgg

SEQ ID NO: 107286 - DNA, 548 bp, Homo sapiens
  misc_feature: GYAE6OF02GCZG8.23.50.E06.1.454.CMB.1.raw
  modified_base (202)..(202): a, c, t, g, unknown or other
  misc_feature (202)..(202): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtggganccagacgtcaccatcacttgccggcgagtcaggacattaacaactattagcctgtatcagcaagaaaccgaggaaacgtacctaaactcctagatctagtgtgacatcctactttgcaatcgaggcctccatctcattcagcgnagtgatcgtgganagtnttcngtctacacatcagcacgtctgcagtcctagaacgtacgttgacttaacttattacgtataaacgtaaaagttactaacgtacgttaccgttacccctttcgtaacccgttttcccgggaccccgttacggtaacccgtagttacggtaacggtaacggtaaccgtaaacggtaacgttcgg

SEQ ID NO: 107287 - DNA, 606 bp, Homo sapiens
  misc_feature: GYAE6OF02JH456.23.50.E06.1.454.CMB.1.raw
  modified_base (403)..(403): a, c, t, g, unknown or other
  misc_feature (403)..(403): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttcgtggttacatctttaggaactatgctatcaacgtgggtgcgacaggccctggacaagggcttgagtggagtggggtgatcgaggtcgtctacgatgataacgacagtactttgactacagtaagttccagggcagagtctaccagtgagcacagacacanaccacgagcacagtactacagtacgaactggaggtatacgtaggacctaagtcgtacggaaccgtaccgaaccgggttccggttaagttaacgttttacgttaggtcggtacggtaacgggtacggggtacctaacggtacgttacccgttagggttacggtttgggttagggtttccggtacgttcgggtacggtttacggg

SEQ ID NO: 107288 - DNA, 520 bp, Homo sapiens
  misc_feature: GYAE6OF02II13F.23.50.E06.1.454.CMB.1.raw
  modified_base (430)..(430): a, c, t, g, unknown or other
  misc_feature (430)..(430): n is a, c, g, or t
  modified_base (512)..(512): a, c, t, g, unknown or other
  misc_feature (512)..(512): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatgggggtggatcagcgtctacgatgataacacagactttgcacagaagttccgaggcagagtctccatgacgcacagacacatccacgagcaacagtctacataggaactgagggatcngacatctagaacgacacggccgtagtattagtgtgcgaggacggggcacgatccgtggttaggtgggttggttggtcgtggngttacggg

SEQ ID NO: 107289 - DNA, 504 bp, Homo sapiens
  misc_feature: GYAE6OF02FKRN0.23.50.E06.1.454.CMB.1.raw
  modified_base (451)..(451): a, c, t, g, unknown or other
  misc_feature (451)..(451): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagagtcaccatcacttgccgggcgagtcaggacattaacaactattagcctggtatcagcagaaaccagggaaagtacctaaactcctagatctatggtgcatccactttgcaatcagggctccatctcgattcagcggcagtggatcgtgggagagtatttcagtctcaccatcagcagcctgcagcctgaacgtacgttgactaactttattactgtaacaaagttataactagtcgtccctttnaccgtttcggcccgttaggacctaagtcggtaagacggtacaacgtactacgg

SEQ ID NO: 107290 - DNA, 516 bp, Homo sapiens
  misc_feature: GYAE6OF02HQTJF.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtggatcgagcgtctacgatgataacacagactttgcacagagttcagggcagagtctcatgagcacagacacatccacgagcacacgtctaacagtggaactgaggagtctgacatcagacgacgaccggcgtagtattattgtgcggaggaggggcacagttccgtgttacggtgggttggttggcgtggcgttacggg

SEQ ID NO: 107291 - DNA, 565 bp, Homo sapiens
  misc_feature: GYAE6OF02H3W06.23.50.E06.1.454.CMB.1.raw
  modified_base (202)..(202): a, c, t, g, unknown or other
  misc_feature (202)..(202): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtggganccagagtcaccatcacttgccgggcgagtcaggacattaacaactatttagcctggtatcagcagaaaccagggaaagtacctaaactcctagatctatggtgcatccacttgcaatcagggctcccatctcgattcagcggcagtggatcgtgggagagatttcagttctccacctaatcagcagccctgccacgtccgtagaagtaccgtttgacctaaactttagttaccttagtactaaaaagttataaacgtacgttacgtacccccttttacgtaaccgttttccggaccccgttacgggtaaccctaacggtttacggtaacggtacggtaaccgtaaaaccggtaacgttacggg

SEQ ID NO: 107292 - DNA, 502 bp, Homo sapiens
  misc_feature: GYAE6OF02FRND8.23.50.E06.1.454.CMB.1.raw
  modified_base (465)..(465): a, c, t, g, unknown or other
  misc_feature (465)..(465): n is a, c, g, or t
  modified_base (496)..(496): a, c, t, g, unknown or other
  misc_feature (496)..(496): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggccccctggacaagggcttgagtggatggggtggatcagcgtctacgatgataacacagactttgcacagaagttccagggcagagtctcatgagcacagacacatccacgagcacagtctacatggaactgaggagtctgacatctgacgacacggccgtgtattattgtgcggaggnggggcacgatcctgtagtggtggttgcgtgngtacgg

SEQ ID NO: 107293 - DNA, 541 bp, Homo sapiens
  misc_feature: GYAE6OF02G2QE3.23.50.E06.1.454.CMB.1.raw
  modified_base (203)..(203): a, c, t, g, unknown or other
  misc_feature (203)..(203): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctggtggganccagagtcaccatcacttgccgggcgagtcaggacattaacaactatttagcctggtatcagcaagaaaccagggaaagtacctaaactcctgatctatggtgcatccactttgcaatcagggctcccatctcgattcagcggcagtggatcgtagggagagtatttcgagttctcaccatcagcagcctgcacgcctagaacggacgttgactaacttacttactagtaactaaaagtactaactacgttacgtacccctttctaccgttttccggacccgttacgggtaacctaacgttacggtaacggtaacggtaccgaaacggtaacgtacgg

SEQ ID NO: 107294 - DNA, 626 bp, Homo sapiens
  misc_feature: GYAE6OF02F0B9U.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagagtcaccatcacttgccggcgagtcaggacattaacaactatttagcctggtatcagcagaacgaggaagtaacctaactacctgatactagtggtcgcatcctacttgcaatcacgggctcctactctcgatcacgtcggcgtagtggagtcgtagggagagatttacacgtactacctaccatactagaccagccgtacgcgacgtacccgtagaaacgggtaccgtttacggaccttaaaccgtttaatttaaccgttacggttaaacgtaaaaacgttaaacgttaaaccgtacggttaccggtacccccgtttaacggggtaccggtttacccggtaacccgggtacggggaacccgggttaaccgggtacgggtaaaacgtacccgaaacgggttaaaccgtcgggttaacggg

SEQ ID NO: 107295 - DNA, 504 bp, Homo sapiens
  misc_feature: GYAE6OF02G6DFR.23.50.E06.1.454.CMB.1.raw
  modified_base (432)..(432): a, c, t, g, unknown or other
  misc_feature (432)..(432): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtggatcagcgtctacgatgataacacagactttgcacagaagttccagggcagagtctcatgagcacagacacatccacgagcacagtctacatggaactgaggagtctgacatcngacgacaccggccgtgtattattgtgcggagaggggcacgactccgtgtagttggtggttgcgttgcgtagg

SEQ ID NO: 107296 - DNA, 676 bp, Homo sapiens
  misc_feature: GYAE6OF02G8PPP.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatccctcctgtctgcgtctggtgggacgccagagtccaccatcacttggccgggcgagtcaggactaattaacaacttattacgcctaggtatcagcaagaaaccgaagggaaacgtaacctaaactccgtagatctagtggtgctactcctactttgactaagtcgacgggtcctaccctatcctacgtacttcgaggccggacgtaggttaggacttccggtagggggtaacgtaaggttacttttccgaaggttcctacaccctaattaccgaacgtacgaccgtcccgttacggacctacggtcccgttaagggaaacggttaccggtttacgaacccgttaaacttttaacgttaaccttaaggttaaacctaaaaagtttactaaaccgtacgttaccgttacccccgttttacgtacccgttttcccgggacccgttacgggtaaccctaagttcggtaacggtaacggtaacctaaacggtaccgttacggg

SEQ ID NO: 107297 - DNA, 550 bp, Homo sapiens
  misc_feature: GYAE6OF02GTVEV.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggactatgctatcaactgggtgcgacaggcccctggacaagggcttgagtggatggggtggatcgagcgtctacgatgataacacagactttgacacagaagttccagggcagagtctcatgagcacagacacactaccacgagacacacgtactacatacggaactgaggagtctgactatctagacgacgacggtccgtagttaattagttggtacgcggagggtacggggactaacgtacgttaccgttggttacggttgggttggttcgtcggttgggcggttacgggg

SEQ ID NO: 107298 - DNA, 640 bp, Homo sapiens
  misc_feature: GYAE6OF02GWUAI.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctccaggtatcagatgtgacatccagatgacccagtctccatcctcctgtctgcgtctgtgggagccagagtccaccatctacgttcggccggcgagtcgaggactaattaaactaacttagttacgccgtaggtatcagacaagaaccgaaggaaacgtaacctaaactcctagactcgttagtggtcgtctactacgtactttgactaactcgacggtacccttacctattccgtacggtacttcgacgtcggacgtaggtggtactcggtagggaagtacgttactttcgacgttcctacaacctagtaccgacgtaccgacgtccgtagcgtaccgtacgtaggaacgttccgttacgaactttaaactttacgttaacttacggtaaactaaaagttctaaacgttagtttcctttacccgtttacgtacccgtttaccggaccgttacggtaacttacggttcggttaaccgaagggtttaacctaaggtaccgttggg

SEQ ID NO: 107299 - DNA, 524 bp, Homo sapiens
  misc_feature: GYAE6OF02G8GRK.23.50.E06.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (451)..(451): a, c, t, g, unknown or other
  misc_feature (451)..(451): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtggganccagagtcaccatcacttgccgggngagtcaggacattaacaactatttagcctggtatcagcagaaaccagggaaagtacctaaactcctgatctatgtgcatccatttgcaatcaggctccatctcgattcagcggcagtggatcgtgggagagtatttcagttctcaccatcagcagcctgcagcctagaagtacgttgactaacttattactagtacaaaagtactaacagttcgtacccctttntaaccgttttccggacccgttacgggtaacccaagttcggtaaggtaacggtaactaaaccggtaattacggg

SEQ ID NO: 107300 - DNA, 555 bp, Homo sapiens
  misc_feature: GYAE6OF02GI8IA.23.50.E06.1.454.CMB.1.raw
  modified_base (544)..(544): a, c, t, g, unknown or other
  misc_feature (544)..(544): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttggagtggagtggggtggatcagcgtctacgatgataacacagactttgcacagaagttccagggcagagtctccatgagcacagacacactccacgacgacacagtacctacataggaactgaaggtacgtctgaactagtacgtgacggacgaccgggtccgtagttattagttgtgcggaggacggggacacgtacgttcccgttagttacggttgggttggtttcggtcgttacggnggtttaacggg

SEQ ID NO: 107301 - DNA, 515 bp, Homo sapiens
  misc_feature: GYAE6OF02F1S5N.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtggatcagcgtctacgatgataacacagactttgcacagaagttcagggcagagtctcatgagcacagacacatccacgagcacagtctacatggaactgaggagtctagacatcgtagacgacgaccgccgttgtattattgtgcgaggaggggcacacgttccgtagtaggtgggttggttggcgtggcggttacgg

SEQ ID NO: 107302 - DNA, 720 bp, Homo sapiens
  misc_feature: GYAE6OF02FJ6I1.23.50.E06.1.454.CMB.1.raw
  modified_base (543)..(543): a, c, t, g, unknown or other
  misc_feature (543)..(543): n is a, c, g, or t
tcagacgcgagtatcacgaccggtgctcgatttagatctactgacaacacacaaggggcgagaagtactctctcagtcaggacacagcatggacatgagggtcctgctcagctcctgggactcctgtctgctctcggctcccacggtatcagatgtgcatccagatgacccagtctccatccttcccctgtcctgtccgtccgttagtcggggagtcccaggacgtcacctaactcacccttggcccggggcgtaacgtcgacggagacttaaaccaaactttattacgtcctaggttactctagctaagaaacccgtaagggaaaacggttaaccctaaaacctaccgtgtaattcctaacttgggtacgtcaacttcccaacgttttcgaccgtaaatccgtaagggcctttacccagtttacccttcggaactttcccaaggtccggtaccggtagttagggacgtaccgtttacggggaggaacgttacgtttaacgtcgtaccttcctaaccacgtaacgtgacgccgacccgtaccncgacccgttagaacgtaccgtaggttaccctaaacctttttatacgtttaaagcttaaaaacgtataaaccgttcgtacggtttcccctctttaacccggttaccggacccccggtttgggaaaccgtaccgttagaacggttaaaccggggactaaaccggtacggtgttaaccgg

SEQ ID NO: 107303 - DNA, 750 bp, Homo sapiens
  misc_feature: GYAE6OF02JS4GC.23.50.E06.1.454.CMB.1.raw
  modified_base (287)..(287): a, c, t, g, unknown or other
  misc_feature (287)..(287): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttctggtggcggcagcaacaggtgcccactcccaggttcaactggaacaatctggagctgaggtgaagaggcctggggcctcgagtgaaggtctccgtgcaaggcttctggttacattctttaggaactatgctatcaactgggtgcgacnggccctggacaagggcttggagtggagtggggtggatcgaggcgtacgtacgagttgaataacgacaagtacgtttgacgaacgtagaagtttacccgaggggtccaaggtaacggttcctacctagtcggaacggctaaccgaacgaacgaactactacccgaacgacgtaccaacgtacgttaccgaacgtaacgtaacgggtaaccgtagtaacgggtaggtaccgttaacggaaaccgtaaccgtttaccgtaacggtaaccgggtaaacccgtaaccgggttacccggttaacggtttaaacgtttacgttttagggtaccgggttaacggggtaacggggaaccgggggttaccgaaacgttaacccggttacccggtttaaggggttaccgggtttacggggggtttaccgggtttagggtacccggttacggggttaccgggttttaaccggggg

SEQ ID NO: 107304 - DNA, 605 bp, Homo sapiens
  misc_feature: GYAE6OF02JJ6WL.23.50.E06.1.454.CMB.1.raw
  modified_base (156)..(156): a, c, t, g, unknown or other
  misc_feature (156)..(156): n is a, c, g, or t
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (449)..(449): a, c, t, g, unknown or other
  misc_feature (449)..(449): n is a, c, g, or t
tcagacgcgagtatcacgaccggtgctcgatttagatctactgacaacacacaaggggcagaagtctctctcagtcaggacacagcatggacatgagggtcctgctcagctcctgggactcctgctgctctggctcccaggtatcagattgtgacntccagatgacccngtctccatcctcctagtctgctcagtggganccagactcaccatcacttggaccgggnacgtcaggactattaacaactatttagcctaggtactcagtacacgaaccgaggaacgtaacctaagtcctaggactactagtggtgactactcctaactttcgactactacgaggtcctaccgaacttctacgactttacgagtccggtactgtagtacttaccgagggacgtagtacgtttactacggtcctacgacctaacgtccaaggctacgtccgngctacggtcctaggaagtactccgtaataccgttaattcttacggtaactaaaggttctaaagcgttacgtaccccgtttacgtaactttccggtaacccttcgggaaacctttagtaccggttaacgacggttacctaaacggttaaccttcggg

SEQ ID NO: 107305 - DNA, 641 bp, Homo sapiens
  misc_feature: GYAE6OF02ITPPC.23.50.E06.1.454.CMB.1.raw
tcagacgcgagtatcacgaccggtgctcgatttagatctactgacaacacacaaggggacccaaaaaccacacccctccttgggagaatccccctagatcacagctccgcaccatggactggacctggagcatccttttcttggtggcggcagcaacaggtgcccactcccaggttcaactggaacaatctggagctgaggtgaagaggcctggggcctcgagtgaaggtctctgcaaggcttctggttacatcttaggactatgctatcaacgtggtgcgacacggccctggacaagggtcttggaggtggagtgggggtggatcgaggtcgtctacggatgaactaacacgtagtacgtttgacaacgtaggtaacgttaccgagggtactaaggtacgtcctaccgtagtcggacgacacgacgtaacacacgtaccgaacgacgacaacgtacgtcgtaacgacgtaggaacgtagggacggtacgtacgtagtaccgtagtaccgtacgaaccggtacgaccggtacgttacggttaagtttagttcggtggaccggtagggacggggtaccaacgtacgttaccgttaggttacggttgggttacgggttacgtcggttcggtacggttacgggg

SEQ ID NO: 107306 - DNA, 599 bp, Homo sapiens
  misc_feature: GYAE6OF02IYZK0.23.50.E06.1.454.CMB.1.raw
  modified_base (229)..(229): a, c, t, g, unknown or other
  misc_feature (229)..(229): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtgggagccagacgtcaccatcacttggccgggngagtcaggacattaacaactattagcctggtatcagcagaaaccaggaagtacctaactcctagactctatggtgcactcctacttgactaatcaggcctccatctacgatttcacggccggtctaggtggtatccgtagggtagtagtatttcgaagttctacaccctataccgagtcagtaccctgactcgacccgttagaacggttaccgttagacttaaaccgtttacttacgttaagtaacgtaaaagtacgttaacgtacgtaccggttacccctttacgttaacccgttttcccggtaccgttacggtaacccgtaacgttcgggttaacgtaacggttaaccgtaaaccggtacgttacggg

SEQ ID NO: 107307 - DNA, 526 bp, Homo sapiens
  misc_feature: GYAE6OF02GD0W8.23.50.E06.1.454.CMB.1.raw
  modified_base (202)..(202): a, c, t, g, unknown or other
  misc_feature (202)..(202): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtggganccagagtcaccatcacttgccgggcgagtcaggacattaacaactatttagcctggtatcagcagaaaccaggaaagtacctaaactcctagatctatggtgcactccactttgcaatcagggctcccatctcgattcagcggcagtggatcgtgggagagtatttcgagtctcaccatcagcacgcctgcacgcctagaacgacgttagactaactttattacgtagttacaaaaagtataacagtcgtaccccttttacaccgtttccggcccgttaggaaccctaagtcggttacgacgggtaccaaacggtacttacggg

SEQ ID NO: 107308 - DNA, 587 bp, Homo sapiens
  misc_feature: GYAE6OF02H8IF3.23.50.E06.1.454.CMB.1.raw
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccngtcctccatccctcctgtctgcgtctggtgggacnccagagtccaccatccattcggccgggcgagtcaggactattaacaactattagcctggtatcagtcaagaaaccgagggtaaaacgtacctaaacgtcctagactctatgtgacatccatttcgacaatcgagggcctacccattcacgtcttcgagccggacgaggtcggtagtcgtaggggagaacgttattcagttcaccaccagtcacgacgacgcctcgacgacgtaccgtagtaacgtaccgttgacgttaacttagttacctagtaacaaaagttactaactacgttaccgtacccctttggtacccgtttccggtacccgtacggaaccgtaagtacggtaggttaaccggagtaaacccggtattaccggg

SEQ ID NO: 107309 - DNA, 693 bp, Homo sapiens
  misc_feature: GYAE6OF02J0VC8.23.50.E06.1.454.CMB.1.raw
  modified_base (150)..(150): a, c, t, g, unknown or other
  misc_feature (150)..(150): n is a, c, g, or t
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
  modified_base (220)..(220): a, c, t, g, unknown or other
  misc_feature (220)..(220): n is a, c, g, or t
  modified_base (250)..(250): a, c, t, g, unknown or other
  misc_feature (250)..(250): n is a, c, g, or t
  modified_base (566)..(566): a, c, t, g, unknown or other
  misc_feature (566)..(566): n is a, c, g, or t
tcagacgcgagtatcacgaccggtgctcgatttagatctactgacaacacacaaggggcagaagtctctctcagtcaggacacagcatggacatgagggtccctgctcagctcctgggactcctgctgctcgtcggcccctacgtagtcngatgtgacatccngatcgaccacgctcctacnccttccctgtctcgtcgtcctgggtacggcgaccgacnggtaccaccatcaacgttcggaccggcggngtacgacggactaataccttaaactacgttgtcctcggtagtacaggaaccaacgtaaaccggaacggtaaacgttaaacccttaactacccgtgtaactacgttaccgtaggtacgtaccgaccttaccgtttaaccgttacggaacaaacgttccggtacccggggttaacctcccccgttaagtaccccgtcgtttaaacggtacacggtaaccggggcctttaacgggccgggtttacgtaggtaacgggtagtagttaaccgttcgttacgtactaaccgtacctacgtcgacgacgtacgtctcgtaccncgtacgaggtacgtacgtgtaactacgttaactaccgtaaagtctaaagtaacgttacaccgttacgtccttacgtccgttaccgtcgtaccgtagacgttagacgtacgtaacgactacgtcgtag

SEQ ID NO: 107310 - DNA, 708 bp, Homo sapiens
  misc_feature: GYAE6OF02I4JUC.23.50.E06.1.454.CMB.1.raw
  modified_base (202)..(202): a, c, t, g, unknown or other
  misc_feature (202)..(202): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctccaggtatcagatgtgacatccagatgacccagtctccatccctcctgtctgcgtctgtcggganccagacgtcacctatcacgttggcccgggcgagtcgaaggtacaattaacaacttatttacgccgttaggtaactcgaagacaagaaaccgaagggtaaacgtaacctaaactcctagtaactactagtcggtagactacttacctacgtttcgactaactcgtacgggtcctaccgtacttcgtcgaactttcgaggtccggacgtacggtcgggtacttacggtaggggaatacggttactttcggtacgttccgtacctacgtactacgacggttacacgtccgtcgactacgaccgtaggtaacgtaccgtttcgaaaccttaactttacgtttaaccgtaagttaaaccgtaaaaacgtttaactaaccgtacgggttttaccctaccccgtttttacgttaaccggttttaccggggttaccccgttacggggtaaacccttaacggttacggttaaccgggtaacggtaaaccggttaaacccggttaggttaaccggg

SEQ ID NO: 107311 - DNA, 717 bp, Homo sapiens
  misc_feature: GYAE6OF02JNF87.23.50.E06.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
tcagacgcgagtatcacgaccggtgctcgatttagatctactgacaacacacaaggggacccgaaaaaccaacaacccctcccttgggagaatcccctagatcacagctccgcaccatggactggacctggagcatcctttcttggtggcggcagcaacaggtgcccactcccaggttcaactggaacaatctgganctgnggtgagaggcctggggcctcgagtgaacggtctccgtgcaaggcttcgtggttacntctttaggactatgctatcaactgggtgcgacgcggcccgtggacaagggtcttggagtggtacgtggggtcgatcgaaggtcgtacgtacgtagtgaacgtaacgacctaggtaacctttggacctaacggtaacgtaacggtttccgaacgggggtctaacggtacggttcctacgacgttagaccggtctaacgacgtacacgtactaccgacgacgcgaaccgtacgtccgtaagtacgtaacggtacggttacgaagggttacgtacgtacgtaccggtacgtaccgttacgaccggtaaccgtaccggggtcccgttaaggttaacgtttaacggtacggttcggaaccgggtaggtaacgggggttaccaacggtaccgttacccggttacgggttacgggtttacggggttaggttccggggtaccgtttggggtacccggtttaccggggg

SEQ ID NO: 107312 - DNA, 555 bp, Homo sapiens
  misc_feature: GYAE6OF02JXFTR.23.50.E06.1.454.CMB.1.raw
  modified_base (358)..(358): a, c, t, g, unknown or other
  misc_feature (358)..(358): n is a, c, g, or t
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
  modified_base (508)..(508): a, c, t, g, unknown or other
  misc_feature (508)..(508): n is a, c, g, or t
  modified_base (546)..(546): a, c, t, g, unknown or other
  misc_feature (546)..(546): n is a, c, g, or t
tcagacgcgagtatcacgaccggtgctcgatttagatctactgacaacacacaaggggacccaaaaaccaacaacccctccttgggagaatccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggtctggacgtggagtggggtggatcgagcgtctagatgataacacagactttgacanagtagttccagggacagaatcgaccagtcgatcgacagacacataccacgaagacacaagtctacactggtaaacctggagtagctaggacatccgtgaacgacacggtccgtgtaattgtttaggngcggtaagggnggtcgtaaccgngttacccgtagttcggttggtcggtttcgacgttcggnggttaacgg

SEQ ID NO: 107313 - DNA, 702 bp, Homo sapiens
  misc_feature: GYAE6OF02IBFAT.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggcctcccaggtatcagatgtgacatccagatgacccagtctctatcctcctgtctgcgtctggtgggagccagagtcaaccattccacgttcggccggggacgtagtccgaaggactaacttaacaaacttatttaacgccgttaggtatcgtagacaacgaaaaccgaagggaaaacgtaacctaaaccttcctagaacttctaagtggtcgtactattcccgtactttacgactaacgttcgaacgggtccctaccccgtattaccgtaccggttacttaccgacgggtaccgggacgtaagggttcggtaacgtttcggtaggggtaacggtaagttaacgttttcgtaacgtttctacctaaccctataccgacgtaccgaaccgtcccgacgacgacccgtaagaaacggttaccgttaggtaccttaaacgttagtttaaccgttaagtaacgtaaaaagtaacttaacgtagttcccttacccttttacgtaccgtttacccgaccgttccggtaacctaagttacggtacggtacggtaaccaacggtacctaggtaccg

SEQ ID NO: 107314 - DNA, 510 bp, Homo sapiens
  misc_feature: GYAE6OF02GG7HC.23.50.E06.1.454.CMB.1.raw
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (502)..(502): a, c, t, g, unknown or other
  misc_feature (502)..(502): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactggtgcgacaggcccctggacaagggcttggagtggatggggtgatcagcgtcgtacgatgataacacagactttgcacagaagttccgagggcagagtctccatgagcacagacacactccacgagcacacgtctaacataggaacgtagaggagtctgacatcagacgacgacgcgtgtattatgtgnggaggngggcacgatcgtggtagttggtggttgcgtgngttacggg

SEQ ID NO: 107315 - DNA, 738 bp, Homo sapiens
  misc_feature: GYAE6OF02GRW2V.23.50.E06.1.454.CMB.1.raw
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctggaggtgaagagggccgtggggcctcgaggtgaaggtctcctgcaaggcttctggttacattcgttaggaactatgctatcaacgtgggtgcgacgacggccccgtggaccaagggtcttaggaggtggagtgggggtgagtcgaggcgtacgtacgagtagataacgactagtactttagacacgaagtaacgttccgaggggacctaaggtacgtccgtaccgaagttcggacgtaccaacgaacggaaccaacctaaccgtacccgaacgaacggaccaaccgtacgtacctaacgtaacgtaacggtaacgttaggacggtaacggttaccgttaacgtaaccgtaacgtttaccgtacgggaacccgaccgggtaaccgggttacccggtttacggtttaaaccgtttacgtttacggttacgggtaccgggtaacggggtaacgggggtaccctaaccggttaccgtttacggttacgggttacgggtttggggttaccgggtttcgggtacgttacgggtcggggtttaaccggg

SEQ ID NO: 107316 - DNA, 525 bp, Homo sapiens
  misc_feature: GYAE6OF02F8EBD.23.50.E06.1.454.CMB.1.raw
  modified_base (371)..(371): a, c, t, g, unknown or other
  misc_feature (371)..(371): n is a, c, g, or t
  modified_base (517)..(517): a, c, t, g, unknown or other
  misc_feature (517)..(517): n is a, c, g, or t
tcagacgcgagtatcacgaccggtgctcgatttagatctactgacaacacacaaggggacccaaaaaccacacccctccttgggagaatcccctagatcacagctccgcaccatggactggacttggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtggatcaggcgtctacgatgataacacagactttgcacagaagttccagggcagngtctccatgagcacagacacatccacgagacacacgtctacagtggaactgaaggagtctgacatctgaacgacgacggccgtagttagttattgtgcgaggacggggacacgagttcctaggttaggtgggttggttgtcgtggngttacggg

SEQ ID NO: 107317 - DNA, 608 bp, Homo sapiens
  misc_feature: GYAE6OF02HAWVH.23.50.E06.1.454.CMB.1.raw
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacntctttaggaactatgctatcaactgggtncgacacggcccctggacaagggcttgaggtggagtggggtggagtcgagcgtctacgatgaataacacagactttgacacaggaacgtttccgaggcagaacgtcctaccagtcgagcacgagaaccacactccagacgacacacgtactaacgactaggaacctggacggacgtactggaacaagtcgtacggaacgaccggtaaccggccgttacggttaacgtttacgttggttacgggacggaagggtacgggggcctaacgaaccgttaccgttaggttacgggttgggttacgggtttcggcggttcggtacgttaacgggg

SEQ ID NO: 107318 - DNA, 663 bp, Homo sapiens
  misc_feature: GYAE6OF02I3SKR.23.50.E06.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (335)..(335): a, c, t, g, unknown or other
  misc_feature (335)..(335): n is a, c, g, or t
  modified_base (386)..(386): a, c, t, g, unknown or other
  misc_feature (386)..(386): n is a, c, g, or t
tcagacgcgagtatcacgaccggtgctcgatttagatctactgacaacacacaagggggcagaagtctctctcagtcaggacacagcatggacatgagggtcccctgctcagctcctgggactcctgctgctctggctcccaggtatcagatgtgacatccagatgacccagtctccatccctcctgtctgcgtctggtcgggacnccagngtccaccatcacgttggccgggcgagtcaggactaacttaactaacttatttacgccttaggtactcgacgtacaacggaaaccgaaggaaaacgttacctaaacgtcctacgatcgtatggtnctactcctattcgacaatcgacggctcccattctcgtatacgacgaccggntacggtacggtatcggtagggaagtacgtatttacgtacgttacctactaccgtactccgacgaccacgtccgtacgaccgacgtaccgtaacgaaacggttaccgttgtaaccgttaaccgttttaacttaacgttaacgttaaactaaaaacgttaccgtaaacgtaccgtttaccgttaccccgttttaccgtacccgttttacccgggtaccccgtaccggttaaccgtaacgttacggtacggtaacggtaaccgtaacggtacgttacggg

SEQ ID NO: 107319 - DNA, 623 bp, Homo sapiens
  misc_feature: GYAE6OF02HPHXR.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtctccatcctccctgtctgcgtctggtcgggagccaggacgtcaccatccacttggccgggcgagtcaggactaattaaacaacttatttaagccttaggtactcagacaagaaaccgaagggaaacgtaacctaaactcctagtatctagtggtgcactcctactttcgacaactcgacgggcctaccctatctacgtactcgacgtcggcgtaggtggtacgttcggtagggaagtaggtactttcgagttctaccactataccgacgtctacgtaccgtcgacgtcgtaccgtagaacgttacgttcgaaccttaattaccttaacgttacgtaaactaaaacgttaactaacgtacgttaccgtacccgtttacgtaccggtttccgggacccgttacggtaacctaggttacggtacggtaacggtaaccgtaaacgtacgtcggg

SEQ ID NO: 107320 - DNA, 583 bp, Homo sapiens
  misc_feature: GYAE6OF02FLAJJ.23.50.E06.1.454.CMB.1.raw
  modified_base (243)..(243): a, c, t, g, unknown or other
  misc_feature (243)..(243): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttnggttacatctttaggactatgctatcaactggggtgcgacgaggccccctgggaccaaaggggccttaggaggtgggagttgggggtggatcgaaggtcgtcgtaaggatgaataacacagtactttgcacagtaagtccgaggcagagtctccagtgagtcacgagacacactaccacgagcaacagtctaacagtagtacgagaggacgtcgtagactagtctagacgtacgaccggtcgtacgttattagttgtcgacggacggaaggggccaacgtacgttccgttaggttagggttcgggttggtttcgggtaccgttgggtaccggtttacggg

SEQ ID NO: 107321 - DNA, 587 bp, Homo sapiens
  misc_feature: GYAE6OF02F4F2D.23.50.E06.1.454.CMB.1.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtctccatcctcctgtctgcgtctggtcggacgccagacgtcacctatccacgttggccggnagtcaggactacttaaacacttattacgctaggtatcganacaagaaaccgaggaaactaacctaactctagactctagtgtnactactcctacttgactaagtcgaggtcctaccatctacgtattcgagtcgacgtagtggactcggagggaataggtactttacgacgtcctaccgaaccgtactcgaacgtccacgtcacgcacgtcctagtaacgtagttacacttaactttacttacgtaagttaacaaaacgttacaacgtcgttaccgttaccctttacgtaccgttaccggacccgtaggtaaccgtagttacggtaacgtaccgtaacgtaaccgtgttacggg

SEQ ID NO: 107322 - DNA, 760 bp, Homo sapiens
  misc_feature: GYAE6OF02IZ6FG.23.50.E06.1.454.CMB.1.raw
  modified_base (213)..(213): a, c, t, g, unknown or other
  misc_feature (213)..(213): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgaacccagtcctaccatccctccctgtcctgcgttcgtggtggggacnccaggacgtccaccatccacgttcggccggggacgacgtcgaggacaattaaacctaacttatttagccgtaggtatcagcaagaaaccgaaggaaacgtaacctaaactcctgactctagtggtagctactcctactttgacaatcgacgggtacctcccacgttctacgtacttacgacgcggacgtagggtcgggtagtccggttaggggaagtaacggttacgtttaccgtacggttacctaccgtaacccgtattaccctaacgtcccgtaacgtcccgttcgaaccgtacgtacccggtaacgtaaacggttaccggtttacgaccctttaaaaccgtttatttaaacccttaaggtttaaaccgtaaaaaacgttaaccgttaaaacgttcccgggtttaacccgtttccccccggttttaaccggtttaacccgttttccccgggtaaccccggtttaacccgggttaaccccgtaaggtttacgggttaaaccggttaacggttaaacccggttaaacccggtaacgtttacccgggg

SEQ ID NO: 107323 - DNA, 806 bp, Homo sapiens
  misc_feature: GYAE6OF02H19R5.23.50.E06.1.454.CMB.1.raw
tcagacgcgagtatcacgaccggtgctcgatttagatctactgacaacacacaaggggacccaaaaaccacacccctccttgggagaatccctagatcacagctccgcaccatggactggacctggagcatccttttctggtggcgcagcaacaggtgcccactcccaggttcaactggaacaatctggagctgaggtgaagaggcctggggcctcgagtgaaggtctacctgcaaggcttctggttacattctttaggaacttagtgctatcaacgtgggtgcgacgacggtcccctaggacgaaacgggtcttacggaggtcggtagtgggggtgtattaccgaggtccgttactacggattcggaacgttaaacaccgtaaggtaccttttggacctaacgtaacggtaacgtttaccggagggtacctaaggtaacggttccttaaccgtagttacggaacgaccgtaacgtaacgaaccgtaaccgtacgttaccccgtaacggaaccgtaccgtaaaccgtacggttacccttaaacggtacggtttaacgggtaaaccgttacgggaaagggttaaccgtaccggttaacggtaaaccggttacgttacccggttaagggaacccggtaacccgggttaccggggtacccgggtttacggttaacgttttaacgttacggtttaccgggaaccgggtaacgggtaacgggggtaccgtaacgtaacggtttaacccgtaggtttaacgggttcgggttagggtttaccgggtattccggggtacgttttaacccggggg

SEQ ID NO: 107324 - DNA, 730 bp, Homo sapiens
  misc_feature: GYAE6OF02H83D4.23.50.E06.1.454.CMB.1.raw
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (379)..(379): a, c, t, g, unknown or other
  misc_feature (379)..(379): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggcctacccaggtatcagatcgtgacatacagatcgaccctagtcctccactcccttccctgtcctgcgtctggtcgggacnccagacgtccaacctntcctacgttcggccggggacgtaggtaccagggtaactaacttaaacctaacgtaactttacggccttaggtactacgaggtaccaaacggaaaaccgagggtaaaacgttaacctaaaaccttccgtagattaccgtaaggtcggtntactaacgttcctacttacggactaaacgtcggaacgggtccctacctacttacgtcgtacgttacgacggtccggacgtagggtttacggaacgtttcggagggtaacgtacggttacttacgacgttctaccgtacagtaccgcacgaccgtccgtgaaccgacggtaccgacggtaaacgggtccgttaacgtaaccttaaacgttacttaacgtacgttaaataaaaccggtaattaaccgtacggtttcccgttaccccgttatttaccccggttcgggtaacccttacgggtaaacctacggttaacggaagtaacccgttaacggtaaaccggtgttaacgggg

SEQ ID NO: 107325 - DNA, 806 bp, Homo sapiens
  misc_feature: GYAE6OF02JWGYG.23.50.E06.1.454.CMB.1.raw
  modified_base (205)..(205): a, c, t, g, unknown or other
  misc_feature (205)..(205): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccattccctcctgtctgcgtctggtcggacnccagagtccacctatcacgttcggccgggcgagtcgaaggacctaattaaacaacgttatttaacgccttaggtaactcgtacgacaagaaaccgagggtaaacgtaacctaaactcctagtactacgttacgtggtcgactactacctactttcgacctaagtaccgtacgggtaccctaccgtaactccttacgtacgtttaccgacggtccgggtacgtacgggtacggtacgttaccgggtagggggtaacggtaacggttaacttttacgtacggttaccctaacccgtaacccgttaacttaacccggaacgggtaaccctacccggtacccgttaccgacccgtaacggtaaccccggttaaggtaaaccggtttacccgtttaccggtaaacctttaaaacccgttttaacgtttaaaccgttaacgtaaaaccgttaaaaaacgtttaacgttaaaccttaccgggtttaacccttacccccgtttttaaccggttaacccgttttacccgggtaacccggttaccgggtaaacccttaggttacgggttaaccggtaacggttaaccggttaaaccgtacggtttaccggg

SEQ ID NO: 107326 - DNA, 726 bp, Homo sapiens
  misc_feature: GYAE6OF02J1S7G.23.50.E06.1.454.CMB.1.raw
  modified_base (209)..(209): a, c, t, g, unknown or other
  misc_feature (209)..(209): n is a, c, g, or t
tcagacgcgagtatcacgaccggtgctcgatttagatctactgacaacacacaagggggcagaagtctctctcagtcaggacacagcatggacatggagggtccctgctcagctcctgggactcctgctgctctggctcccgaggtactcagatgtgacatccagatcgacccagtctccatccctcctgtctgcgtcgtggtgggacnccagctccacctatcctacgttcggccgggtcgagtccgaaggaactaattaaacgaacttagtttaacgccgttaggtactcgaagtaccgaacggaaaccgaagggaaaaccgttaacctaaaaccgttaccgtacggtacttaccgtagtcggtagacctaataccctacgttttcgacctaataccgaacgggtcctacccgtagtccgttacgtattaccgacggcggtccgagggttccgtaagtcggttagggaacgtagttacgtttacgaacgttccaccgtacttacgtacgacgcgtaccgcgttacgacgtacgtccgtaagaccgttacggtacgtacgttaacctttacgttaacctacggttaaactaaacgttaacgttaacgtaccgttaccgtttaccccgtttacgtacccgtttaaccgggacccgtttaacccgggtaacttaacgtttacgggtaaccgtaacgggttaaccggtaaacgtaccggtttaccggg

SEQ ID NO: 107327 - DNA, 794 bp, Homo sapiens
  misc_feature: GYAE6OF02HJ9WO.23.50.E06.1.454.CMB.1.raw
  modified_base (205)..(205): a, c, t, g, unknown or other
  misc_feature (205)..(205): n is a, c, g, or t
tcagacgcgagtatcacgaccggtgctcgatttagatctactgacaacacacaaggggggcagaagtctctctcagtcaggacacagcatggacatgagggtccctgctcagctcctgggactcctgctgctctggctcccaggtatcagatgtgacatccagatgacccagtctccatccctccctgtctgcgtctggtggganccagacgtccaccatccacgttcggccggggacgacgtcgagggactaattaaaccaacttatttacgctggtatcagcaagaaaccgagggtaaactaccgtaaactcctagacttctagtggtgactacttacctactttggacctaaagtcgaacgggtccttacccgaacgttctaccggtactttaccgacggtccggtacgaagggttcgggaacgttcgggtacgggggtaaggtaacggttaacgtttttaccggaacggtttcccttaacccgtaaacccgtaactttaccgaacggtaccgtaaccggtcccgttacggtaccgtacccggacccgttaacgggtaaacggtaccggtttacgaacccgtttaaaccttttaagtttaaccgttacgttaaaacgtaaaaaccgtttaacgtaaaccgttaacggtttacccgtttacccccccgtttttacggttaaccccgtttttacccgggtaccccggttaaccggggtaaacccttaacggtttaccgggtaaacggttaaccgggttaaacccgtaaaacccgggttaggtttaacccgggg

SEQ ID NO: 107328 - DNA, 714 bp, Homo sapiens
  misc_feature: GYAE6OF02JXS86.23.50.E06.1.454.CMB.1.raw
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
tcagacgcgagtatcacgaccggtgctcgatttagatctactgacaacacacaaggggcgagaagtctctctcagtcaggacacagcatggacatgagggtccctgctcagctcctgggactcctgctgctctggctcccaggtatcagatgtgacatccagatcgacccacgtctcctactccctcctgtctgcctntgtgganccagacgtcaacctntcacttcgccgggacgacgtcgaacggactaacttaactaacttacttacgccgttagtatcagtacaacgaaaccgaacggtaaacgtaccctaaactcctagagttactagtaggtcgtacactcctactttacgactaataccgtaggtaccctacctagtaccctgttacttaccgacggtaccggtccgtaggttacggtacgtacggtagggtacgaagtttactttcgaacgtccttaccgaactacgtaccaaggtcctacggtccctaagtccgactaccgttaacgggtaaacgtaccgttacgtaaccttaacgtttaacctaacgttacgttaaaccgtaaaagttaacccgtaacgggttacctcctttaacccgttttacccttaaccggtttacccggtacccggttaaccgggttaaccgttaaccgttaacggacccgggttaagttaaccccggtaaacggttaacccgggtacgg

SEQ ID NO: 107329 - DNA, 693 bp, Homo sapiens
  misc_feature: GYAE6OF02HAFEF.23.50.E06.1.454.CMB.1.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
tcagacgcgagtatcacgaccggtgctcgatttagatctactgacaacacacaagggaccaaaaccacaccctccttggagaatccctagatcacagctccgcaccatggactggacctggagcatccttttcgttggtggcggcagcaacaggtgcccactcccaggttcaactggaacatctgganctgaggtgaagaggccgtgggcctnagtgaaggtctcctgcaaggcttcgtggttacattcgttttaaggaactatcggcttatactaacgtgggtcncgtaacgaggtcccctggaacgagggtcttagagttcggaggtgggggtanagttcgaggtacgttctaaggattggaaaacttaaccgactaagtccttaggaccaacgtaacggtaagtcccgaaagggcaacggtaagttcctacgagtgaacgcacgagaactacactaccacgacgacgacgtaacgtactaacgtaacgtaacggtaacgtggtaaacggtcgttaacgtacgaacgttacgtacgtacggaaaccgaaccggtaaccgggtccggttaaacgttaacgttttacggttaggttacgggacggtaacgggtaaggggaccttaacgtaaccggtaccgtttagggtacggtttacgggttgggttacggctttggggtaccttaacggggg

SEQ ID NO: 107330 - DNA, 877 bp, Homo sapiens
  misc_feature: GYAE6OF02HUMGQ.23.50.E06.1.454.CMB.1.raw
  modified_base (211)..(211): a, c, t, g, unknown or other
  misc_feature (211)..(211): n is a, c, g, or t
  modified_base (354)..(354): a, c, t, g, unknown or other
  misc_feature (354)..(354): n is a, c, g, or t
tcagacgcgagtatcacgaccggtgctcgatttagatctactgacaacacacaagggggcagaagtctctctcagtcaggacacagcatggacatgagggtccctgctcagctcctggactcctgctgctctggcctcccaggtatcagatgtgacatccaggatcgacccagtctccactccctcctgtctgcgttacgtggtggggacnccgtagacgtaccaacctattccgacgttggcccgggtgacgtcgaaggacctaacttaaactaaccttagtttaacgtccgtaggtactcgaagacaacgaaaaccgaacggggtaaaacttaacctaaaaccttcccgtanaacgttctaagttcggtacgtctaactaccctaacgttttcggaacctaaacgttaccggtaacgggtccctttacccgtaacgttccgtaccgtaacgttaccgtacggaccgggacttaacgggttacgggtaaccgtttcgggtaacgggggttaacgtaaacggttttacttttaccgtaaccggttccttaacccgtacccgtaactttaccggaacggtaacccgtaacggtcccgtttaaggacccgtaaacgggtacccgtttaagggaaaaccggttaacccgggtttaccgtaaaccggtttaaaaccctttttaacgtttaaaccccgggtttaggttaaaaaccttaaaaaaaccgggttttacgttaaacccttaaccgggtttcctttaaccccccgtttttaaccggaaccggtttttccccgggtaacccggttaacggtaacccgttaacggtttacgtaaccgggtaaacgggtttaaccctaaacggttaccggtttaaccggg

SEQ ID NO: 107331 - DNA, 720 bp, Homo sapiens
  misc_feature: GYAE6OF02J0Y1B.23.50.E06.1.454.CMB.1.raw
tcagacgcgagtatcacgaccggtgctcgatttagatctactgacaacacacaaggggcagaagtctctctcagtcaggacacagcatggacatgagggtccctgctcagctcctgggactcctgctgctctggctcccaggtatcagatgtgacatccagatgacccagtcctccatcctcctgtctgcgtctagtgggagccagcgtcaccatcacttggccggagagtcaggacagttaacacgtattcgcctggtatcagaccaagaaacccgaaggtaacgtaacctaaaccgttcctagaactctagtcggtacgactactccctaacgtttgacctaacgtcgtaccgggaccttacccgagtttaccgtacggttaacttacggaccggtaccggtccgtagggttacgtcgtacggttacgggagtaaaggttactttacgtactaccgttaccaacccttagttaccgacggtaacctacggtaccgtccggttaccacggtacccgttaagtaaccgggttaccgttacgtacgtttaaaccgttacgtttacgtaaccgttaacgtaaaaacgtttacgtaaccgttccggttacccgttaaccccgttaccgtttaccccggtttacccggtacccgttaaccgggtaacccttaagggttacgtaaagggttaaccccgtaacgtaaaccccggtaacgttacggg

SEQ ID NO: 107332 - DNA, 731 bp, Homo sapiens
  misc_feature: GYAE6OF02HFPUQ.23.50.E06.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
tcagacgcgagtatcacgaccggtgctcgatttagatctactgacaacacacaagggggcagaagtctctctcagtcaggacacagcatggacatggagggtccctgctcagctcctgggactcctgctgctctggctccaggtatcagatgtgacatccagatcgacccngtcctccactccctcctgtctgcgtctggtgggacnccagtacgtccaccgacttcctacgttcgggcccgggtcgtacggttccgaaggaacctaattaaacctaaacgtttaacgtttacgtcccgttaggttactacgaacgtaccgaaaacggaaaaccggaacggggtaaaacgttaaaccccgttaaaccgtccgttaagtaaccttacgttagtcggttacgacctaaccgttccgttaacgttttacgaaccttaacgtcggtaaccgggtccctaacccgtacttcccgttacgtacgttacgaccggtcggacgtacggtacgggtagtccggtagggtagacgttagtttccgagtcctacactacgngtacncgacgtccgtcncgtaccgctacggaagttcgtagtaccttaacgttaactttcgttaagaacgttaaagtactaacgtacgttccgtttaccccttacgttaccggttacccggaccgttacggaacgttacgtacgggttaaccgacgggtaaaccctacgggtaaccttcggg

SEQ ID NO: 107333 - DNA, 960 bp, Homo sapiens
  misc_feature: GYAE6OF02ICGYK.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgacccagtcctccactccctccttcgtctgtcgtcgtggtcgggacgccagtacgtccaccatcctacgttcggccgggacgacgtcgaagggactaacttaaaccaacttaagtttaccgccgttaggtactaccgacgacaaacggaaaaccgtaaggggtaaaaccgtaacctaaaccgttccgtagtaattccttaaggtcggtcgtactacgttacccgttacgttttacgaacctaacgtacgtaccggggccttacccgtattaccgtaaccggttacgtttaccgaccgggtaccgggtactaggggttacgtaacggttacggtacggggtaaacggttacggtttaaccttttacgggtacctttaccgtaacccgtaaccgttaactaccggttaacgacccggtacccggtaccccggaaccgttacccggtaacccggttaaacgggttaaccgggtttaaccggtttaacggttaaaccccgttttaaaccggtttttaaaccttttaacccggtttaaaaacgggttttaaaaccgtaaaaaaacggtttaaaccgtttaaacccgggtttacccggtttaaccccccgtttttaacccccggttttttaccccggtttaaacccccgggttttttcccgggtaaccccccggggtttaaacggtaaaacccccggtttaaaggtttttaccccgggggtaaaacgggtttaaaccccggggttttaaaaccggtaaaacccccggggtttaaccggttccggggttttaaaccccgggg

SEQ ID NO: 107334 - DNA, 697 bp, Homo sapiens
  misc_feature: GYAE6OF02H7BQ4.23.50.E06.1.454.CMB.1.raw
  modified_base (209)..(209): a, c, t, g, unknown or other
  misc_feature (209)..(209): n is a, c, g, or t
  modified_base (480)..(480): a, c, t, g, unknown or other
  misc_feature (480)..(480): n is a, c, g, or t
tcagacgcgagtatcacgaccggtgctcgatttagatctactgacaacacacaagggggcagaagtctctctcagtcaggacacagcatggacatggagggtccctgctcagctcctgggactcctgctgctctggctcccaggtatcagatgtgacatccagatcgacccagtcctccactccctcctgtctgcgttctggtgggacnccagagtccaaccattcacgttcggccgggacgagtcaggacaattaacaactatttagccttaggtatcagacaacgaaaaccgaagggtaaacgtaaccctaaacttctagatactagtggtcgacagtcctactttgactaatcgacgggtcctcctatcctcgtacttcgacggcggtacgaggttacgggagtttcggtaggggtaacgtaaggttactttacgacgttctaacccgtacctaacttacgaacggacaccggtccncggtacctacgtaccgtaggaaacgttacggtttacgacctttaaacgtttactttaaccgttaggtaaaaccgtaaaaaggttaactaaccgttacggttacccggtttacccctttaacgttaacccggttttccgggtacccccggttaagggtaacccgttaaggttacggtaacgggtaaccggttaaccgtaaacccggtacggttacggg

SEQ ID NO: 107335 - DNA, 511 bp, Homo sapiens
  misc_feature: GYAE6OF02FSK7N.23.50.E06.1.454.CMB.1.raw
  modified_base (503)..(503): a, c, t, g, unknown or other
  misc_feature (503)..(503): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtgatcagcgtctacgatgataacacagactttgcacagtaagttcagggcagagtctccatgagcacagacacatccacgagcacagtctacatggaactgaggagtctgacatcgtagacgacgacggcctagtattagtgtgcgaggcgggcacgatccgtgtacgttgggtaggttgcgttggngttacggg

SEQ ID NO: 107336 - DNA, 659 bp, Homo sapiens
  misc_feature: GYAE6OF02GEQHI.23.50.E06.1.454.CMB.1.raw
  modified_base (275)..(275): a, c, t, g, unknown or other
  misc_feature (275)..(275): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggccgtggggcctcagtgaaggtctccgtgcaaggcttcgtaggttacattcgtttaaggaacctagtntcgtatactaacgtgggtgtacgacgacggtccccgtaggaacgtaacgggtcttaggaggttggacggttgggggtgaacgtcgtaggcgttacgtacgtatcgaataaacagtaagtctttaggctaagagtaacgttcgagggacaggtacgtcaccgtagtcacgtcacgagacacgatcccgaagacgacacgactactactagtacggaactaggacggtagttcgagacgtagtaccgtacggaacgaccggaccggtaccttaggttaactttagttgtcggtacgggagggttacgggaccgtaacttaccggttaccgtttagggtacgggtttcgggtttacggttcgggtaccggttgacgggtttaccggg

SEQ ID NO: 107337 - DNA, 795 bp, Homo sapiens
  misc_feature: GYAE6OF02HH2FU.23.50.E06.1.454.CMB.1.raw
  modified_base (151)..(151): a, c, t, g, unknown or other
  misc_feature (151)..(151): n is a, c, g, or t
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
  modified_base (454)..(454): a, c, t, g, unknown or other
  misc_feature (454)..(454): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggcctcccaggtatcagntgtgaccatccagactcgaaccccngttccaccctatcccgttcccnggttctcggcttcgtaggtacggggacacccaaggcgttacccaacctacgtccacggttccggggaccgggtccgaggtacgacggtaactaacttaaactaacgttaacgttacgtaccgtaggtacttacgaacgtaccaacgtaaaccgaagggtaaaccgtaaacctaaacccgttccaacggtactaccgttagttcggtacgtactactacgtacctttgaacctaagtccgtacggaccttacccgtntacccgttacgtacttaccggaggacccggtacgtaggtaccggtaggtcggttaacgggtacgtacgttaccgttaacgtacggttcctaccgaaccttaacgcctacgggcttacgacccgtacgttaccgaacgtcccggtaaacgtaacccgggttaacgttactaccgggtttaaacctttacgttaaaccgttaaccggtaaagttaaaaccgtaccttaacggttaccggttaccccttacccgttacgttaacccgggtaccgttaccgggtaccgttaaacccggttaagtacgggtaacgttaaaccggtaacgtaacccgtagtcccggg

SEQ ID NO: 107338 - DNA, 762 bp, Homo sapiens
  misc_feature: GYAE6OF02IFRRF.23.50.E06.1.454.CMB.1.raw
  modified_base (422)..(422): a, c, t, g, unknown or other
  misc_feature (422)..(422): n is a, c, g, or t
  modified_base (553)..(553): a, c, t, g, unknown or other
  misc_feature (553)..(553): n is a, c, g, or t
  modified_base (660)..(660): a, c, t, g, unknown or other
  misc_feature (660)..(660): n is a, c, g, or t
tcagacgcgagtatcacgaccggtgctcgatttagatctactgacaacacacaaggggacccaaaaccacacccctccttgggagaatcccctagatcacagctccgcaccatggactggacctggaggctacttccttttcgttcgggtgggccggcacgaccaacgtaggtccgacccaccctacccgtacggtacctaacgtacggtaaactaacttcgtacggacgtcgtggaggttaggaacggacggcccggtcggggtccctcgtagggtacgtaacggtccgttcctcggacgaacggtccttaccgtacggttacctacgtttacgttaagtaaacttgtcgtacttactaccgtaaccggtggtcgaccgtaccggaccgtccgtacgggtaacggtacggtcgttacgggntttaggggacggttcggggtacgtcgtacgacgtccgtaacgtcgtacgtacggacttaacgctacgttactacggaccaggaacgttaggtaccgaacgggtacgtagtcgtaccctagtacggaccganaccgaacgtacaaccgaccttcgtaacccgaggacctacgtaacgtccgaacttacgtaggtaacgtccgtaggactcgtctaagctactcgaatacgaccggtacngttacgtagttagtcggcgtagggtacggccggttacacgtttcccggtacggttagttacgggttcggtcgggttctcggttcgggtaccgtttccggggg

SEQ ID NO: 107339 - DNA, 579 bp, Homo sapiens
  misc_feature: GYAE6OF02GFQJE.23.50.E06.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (341)..(341): a, c, t, g, unknown or other
  misc_feature (341)..(341): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctccctgtctgcgtctgtggganccagacgtcaccatccattggccgggcgagtcaggacattaacaactattagcctggtatcagcagaaaccagggaaactacctaactcctgatctatgtgctatcctacgtttnactatcgaggtcctcccgatcctnattcgaggcggtacaggtggatcgtagggnaagtntttcgattcncaccatcagtcgacnccgtcncacgtcctagtaacgtacgttacgaccttaaactttaacgttacttacgtaactaaaagttactaaacgtacggtttcccgtacccctttacgttacccgtttcccggtaccccgttaagggtaccctaggttacggtaacggtaaccggtacctaaacgtaacgttacggg

SEQ ID NO: 107340 - DNA, 691 bp, Homo sapiens
  misc_feature: GYAE6OF02JASH3.23.50.E06.1.454.CMB.1.raw
  modified_base (202)..(202): a, c, t, g, unknown or other
  misc_feature (202)..(202): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatgacccagtctccatcctcctgtctgcgtctggtggganccagacgtcaccatcacgttcggccgggcgagtcgaggactattaacaacttattacgccttaggtatcgagacaacgaaacgagggaaactaacctaaactaccgtagtattacgtagtacggtcgacgtacttacctactttcgactaagtccgaagggtcctaccctatccgtcgtacttcgacgccggtgtacggtaggacttcggtgggaacgtagttaccgttttagacgttcctacacccgtataccgagacctacgaccctgaccgtacgtaccgtacggtaaacggtacctttagaccgttaaaccgttttacgtttaaacgttacgtaaacgtaaaacgttaacttaaaccgtacgttacccgtttacccccgttttacgttaccccgttttacccgggtaccccgtttaacgggtaacccgttaacgttcggttaaaccggtacgggtttaaaccgtaaaccggtaaccgtttacggg

SEQ ID NO: 107341 - DNA, 717 bp, Homo sapiens
  misc_feature: GYAE6OF02JEU9N.23.50.E06.1.454.CMB.1.raw
  modified_base (159)..(159): a, c, t, g, unknown or other
  misc_feature (159)..(159): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagccattccttttcttgatggcggcagcaacnggtgcccactcccaggttcaactggaacaatcgtggagcgtggaggtgaaggacggccgttgggggcccttgaggttaggaacggttcctccgttggacaacgggtcttcgtagggttactattcgtttaaggaactagtcgctaatcgtaacgttgggtcgacgacgacggtccccgtagggaaccgtaagggtcgttagtaggtggtacggtgggggtgacttacgagtcgtactacggatacgtaactaacgaccgtagttaacgttcgaacgaccgaaggttaaacgttccgaaggggtactaaggtacgtacctacgacgttacggacgacaacgaacgtaccaacgtacctaccgacgaccgactaacgacgttaccgtaagtaacggtacgaacgtaggtaaggtcgtacgtagaccttacgtacgtacgaaccgaccggtaccggtagttacgtagttacgtacgtacgggaggacgggtacgggactaacgtacggttacgttagggttagggttacggttacgggttccgtacgggttcggtacgggg

SEQ ID NO: 107342 - DNA, 721 bp, Homo sapiens
  misc_feature: GYAE6OF02HPIXT.23.50.E06.1.454.CMB.1.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
tcagacgcgagtatcacgaccggtgctcgatttagatctactgacaacacacaagggggcagaagtctctctcagtcaggacacagcatggacatgaggggtccctgctcagctcctgggactcctgctgctctggcctccgaggtatcagatcgtgacatccaagtatcgacccagtctccactccgtccngtctgccgttgtggtgggacncctaggactccaacctactcctagttcggacccggtagacgtacgaacggaactaacttaaactaacttacgttaacgtccttaggtactacgacgacaacgaaaaccgtaacggtaaaacgtaacctaaaccttcctacgtaattccgttaagtcggtgtaccgtactaccgtacttttgaacctaacgtacgacgggtcctccctagttcctacgtatacacggtcggacgtagtcggtatcggtagggaagtacgttacgttcgtaacgttctaccaaccgattacgacgtacgtaaccgccttacggacctacggtacctaacgggtaacgtacgttacgtaaccgtaactttacgtaacgtaacgtaaacgtaaaacgtaacttaacgtacgttacccggtttacccttccgttaaccggttacccggtaccccgtaaacggttaccctaaggttaacggtttaaccggaaaccgggttttaacaaaccggtacgttacgggg

SEQ ID NO: 107343 - DNA, 517 bp, Homo sapiens
  misc_feature: GYAE6OF02G32PF.23.50.E06.1.454.CMB.1.raw
  modified_base (281)..(281): a, c, t, g, unknown or other
  misc_feature (281)..(281): n is a, c, g, or t
  modified_base (337)..(337): a, c, t, g, unknown or other
  misc_feature (337)..(337): n is a, c, g, or t
  modified_base (510)..(510): a, c, t, g, unknown or other
  misc_feature (510)..(510): n is a, c, g, or t
tcagacgcgagtatcacgaccggtgctcgatttagatctactgacaacacacaagggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtncgacaggcccctggacaagggcttggagtggagtggggtggatcgagcgtctacgntgataacacagactttgcacagaagttccagggcagagtctcatgagcacagacacataccacgagcacatctaacatggaactgagtagtctagacatctgacgacgaccggccgtagtattagttgtgacgaggacggggcactactccgtgtagtggtggttcgctcggngtacggg

SEQ ID NO: 107344 - DNA, 668 bp, Homo sapiens
  misc_feature: GYAE6OF02HA3T3.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctccaggtatcagatgtgacatccagatcgaccagtcctcatccctcctgtctgcgtctggtgggactccgaagtcgtaccaccattccacgttcgggcccgggtacgagtccgaggactaacgttaaacaacttatttacgccgttggtaatccagacaaggaaacccgaagggtaaaacgtaccttaaaccgtccgtagtattacctaagtgggtatacgtactaccgttactttagaccgtaattccggaacggtccttaccgtactcgttaccgtacttaccgaacggtccggacgtcggttaacggtcgttacggtgggaacgttagttaacgtttaccgacgttccgtacctaccgtaacttccggaaactccgtacgtccgtgggaacctcggtaccgttaaggaaacgttcggttagtaaccttaacgtttagttacgttactaaacgtaaagtactaacgtcgtacttcccttgtccttccggtaccgtacgtaatacgtggtacgtacggtacacggtctcgg

SEQ ID NO: 107345 - DNA, 575 bp, Homo sapiens
  misc_feature: GYAE6OF02F0QE4.23.50.E06.1.454.CMB.1.raw
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (409)..(409): a, c, t, g, unknown or other
  misc_feature (409)..(409): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatcctttttcttggtggcggcagcaacaggtgcccactcccaggttcaactggaacaatctggagctgaggtgaagaggctgggcctcagtgaggtctctgcagctntgtacatcttagaactatgctatcaagtggngcgacgacgcccgtggacgaagggcttaggaggtggaggtggggtaggatcgaggtccgtcgtacgatagtaactaacgactacgtactttgacaacgagtaacgttccgagggcaggtacgttctaccagtggacaccanaacgacaacgactacgacgagcaacgagtacctaacgtagtacggaactggacgtagtcgagtacgatcgtacgacgtaccggacggtcgtgttaacttagttgtagtcggaggacgggacacggtactcgttaggtgttgggttggtgcggttggacggttcggg

SEQ ID NO: 107346 - DNA, 759 bp, Homo sapiens
  misc_feature: GYAE6OF02JMHS1.23.50.E06.1.454.CMB.1.raw
  modified_base (156)..(156): a, c, t, g, unknown or other
  misc_feature (156)..(156): n is a, c, g, or t
  modified_base (207)..(207): a, c, t, g, unknown or other
  misc_feature (207)..(207): n is a, c, g, or t
tcagacgcgagtatcacgaccggtgctcgatttagatctactgacaacacacaaggggcagaagtctctctcagtcaggacacagcatggacatgagggtccctgctcagctcctgggactcctgctgctctggctcccaggtatcagatgtgacntccagatcgacccagtctccatccctcctgtactgccgtctagtcgggacncctaagcgttaccaacctatcctacgttggacccgggtgagtcgaggactaacgttaaccgaaacttagtttaacgtccttaacggttacgttaccgaagtccgaaaggtaaaaccccgtaaaggggaaacgttaaaccctaaaccgttacccgtacgtaacgtaccttaaggttacggtacgtaccgtaacttcccgttaacgttacgacctaacgtacgtacgggtacctcccctaagtcccgtcgttactacgtaacgcggacgtacgtaggtacgtcggtaaggacgtaacgtaacgtttctaagttccgtaccaacgtactaccgacggtacgtacggtacctcggacctacggtactacgtaaacggtaccgttaccggtaaccttaaacgtttacgttaaccgttaccttaaaaggtaaacgttaacgaaccggtttacgttaccggtaccccttttccgtaaccgttttaccggtacccgtttaacggaacccgttaagttaccgtaaaggttaccggttaaccgtaaaccgtccgttaacggg

SEQ ID NO: 107347 - DNA, 689 bp, Homo sapiens
  misc_feature: GYAE6OF02HPP55.23.50.E06.1.454.CMB.1.raw
  modified_base (337)..(337): a, c, t, g, unknown or other
  misc_feature (337)..(337): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctggaggtgaagaggcctggggcctcaggtgaaggtctccgtgcaaggtcttcgtggttacattacgtttaggaactatgactagtacaacgtgggtgcgacgacggcccctaggacgagggtcttggaggtggagtgggggngtatcgagtcgtacgtacgatagaataacacgagtacttgacaacgagtacgttcgagggacagagtctacgagtaggacgtacaacgacgaacaccgacgtacccgaacgacgtaccaacgtacgttacctaacgtaacgtagggtaaaccgtagggaacgggtacgttccggtaagtacctaacgttcgtaacggaaccgtaccggtaaccgggttaccgttaggttaacgttttacgttgggtacggtaccgggtaagggaacggggtacctaaccggtacgttaccggttaggtttcggggttaggggttacgggtttccggaggttcgggtacggtttaaccggggg

SEQ ID NO: 107348 - DNA, 839 bp, Homo sapiens
  misc_feature: GYAE6OF02I699F.23.50.E06.1.454.CMB.1.raw
  modified_base (207)..(207): a, c, t, g, unknown or other
  misc_feature (207)..(207): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtcgcccactcccaggttcaactggaacaatctggagctgaggtgaagnggccgtggggcctcgagtgaacggtctcctgctaaggcttcgtggttacattcgtttaaggaacttatgtactactactaacgtgggtgcgtaaccgacgggtcccccgttagggaaccgtaaaggggtcgttaggtagggttaggggtaggttcggggggtagggtaacgtcggtaacgggtccggttaccgtaacggtaagttacggtaaactaaaaccgtaaccgtaacggttaaaccgttttacggacccgtaaaccgtaaacgggtaaacggttttacccgggaagggggtaccgtaaagggtaaccgttccttaacccgagttaacgggacgaccgaaacgaacggtaaccaacgtaacctaccgaacggtaacgacctaacgtaacgttacctaaacgtacgtagggtaaacttagggaacggtacggtaccgttacggaactacgtacgttaacgggaaccggtaaccggtaccgggttaccggttaagttaacggttttacgttacggttacgggacggggtaacggggtacgggtacggtaaccgtaccggttttaccgtaccggggtttaaggttcgggggttggttacggtaccggttacgggtccggttaacccggggg

SEQ ID NO: 107349 - DNA, 581 bp, Homo sapiens
  misc_feature: GYAE6OF02FKWMC.23.50.E06.1.454.CMB.1.raw
  modified_base (255)..(255): a, c, t, g, unknown or other
  misc_feature (255)..(255): n is a, c, g, or t
  modified_base (476)..(476): a, c, t, g, unknown or other
  misc_feature (476)..(476): n is a, c, g, or t
  modified_base (532)..(532): a, c, t, g, unknown or other
  misc_feature (532)..(532): n is a, c, g, or t
  modified_base (560)..(560): a, c, t, g, unknown or other
  misc_feature (560)..(560): n is a, c, g, or t
  modified_base (570)..(570): a, c, t, g, unknown or other
  misc_feature (570)..(570): n is a, c, g, or t
tcagacgcgagtatcacgaccggtgctcgatttagatctactgacaacacacaaggggacccaaaaaaccacacccctccttgggagaatcccctagatcacagctccgcaccatggactggacctggagcatcctttttcttggtggcggcagcaacaggtgcccactcccaggttcaactggaacaatctggagctgaggtgaagaggccgtggggcctcgagtgaaggtctcctgcaaggcttctggttacntcgttaggactatgctatcaacgttgggtcgcgaacgacggccccctaggtaaccgaaggggtcttggaggtggaggtgggggtggagtcgagtcggtactacgatagaataacacgagtactttgacacgagtaacgtcgaggcgtagtacgtctccgagtcgacacgacagaacacaactaccgaacgtagctaacgtacgtactacagtagtaacggngtaggtagtctaagactagtctacgaacgacgacgtccgtagtacttagtggtcgnggaggaacgggcactagtcgtgttaggnggttgttcgngtggcggtagg

SEQ ID NO: 107350 - DNA, 713 bp, Homo sapiens
  misc_feature: GYAE6OF02H4SSA.23.50.E06.1.454.CMB.1.raw
  modified_base (472)..(472): a, c, t, g, unknown or other
  misc_feature (472)..(472): n is a, c, g, or t
  modified_base (497)..(497): a, c, t, g, unknown or other
  misc_feature (497)..(497): n is a, c, g, or t
tcagacgcgagtatcacgaccggtgctcgatttagatctactgacaacacacaagggggcagaagtctctctcagtcaggacacagcatggacatgagggtccctgctcagcctcctgggactcctgctgctctggcctcccgaggtatcagatgtgacatccagatcgacccagtcctccactccctccctgtctcggtccgtcgtgggtcggacgccagtacgtccacctatccacgttcggccgggagacgtacgaggtacctaaattaacctaacgttatttacgtccgtaggtactacgaacgacaaacggaaaccgaaagggtaaaacctaaccgtaaacctcctagtactacgttagtggtacgtactacgtaccttcgttacgacctaacggtcgacggtacctacctatcgtacgtacttacgacgcggtacgtagtcggtagtacggtagggataacgtttnttacccggaagttcctcgtaaaccngtaccgtacggacgtacctcgtagggactacggtacctaaggaaccggttacgttaccgaacttaaacgtttaccttagtaaacgtaaacttaaaacgtacttaacgtccgttacccgttcccgtttaccgtaaccggtttcccgggacccgttaaaggacccttaaaggttaccgggttaaggtaacccgtaaacgtaaccggtagtttaccggg

SEQ ID NO: 107351 - DNA, 722 bp, Homo sapiens
  misc_feature: GYAE6OF02HDPS0.23.50.E06.1.454.CMB.1.raw
  modified_base (156)..(156): a, c, t, g, unknown or other
  misc_feature (156)..(156): n is a, c, g, or t
  modified_base (217)..(217): a, c, t, g, unknown or other
  misc_feature (217)..(217): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagtatggtnacatccagatcgacccagtcctccacttccctcccgtgtctcggccgtcgtggtggggacnccgaagacgtccacctatctacgttcggccgggacgagttaccgaacggtactaacttaaacctaactttattacgccttaggtactcgagacgaacggaaacggaacggtaaaacgttaacccgtaaacctccgtagtacttacgtagtggtcactactccgttacgttgactacgtcgacggtcctaccactctacgtactcgacggacggtacgtaggtacggcgtacggtagggacgtaagttactttacgacgttccgtacgacctacgtacgacggtaccggaccgttccgtacgacgtaccgtcgggtaacggtaaccggttacgttacgtaaccgtttaaactttaccgttaacgttaacgtaaaccgttaaaaacgttacgtaaccgtacggtttcccttaccccgtttaccgttacccggttacccggtaccccggttaggtaacccgtaacgttacgggtaacggtaccgtaaaccggttaagaccgttacggg

SEQ ID NO: 107352 - DNA, 625 bp, Homo sapiens
  misc_feature: GYAE6OF02F5YN2.23.50.E06.1.454.CMB.1.raw
  modified_base (204)..(204): a, c, t, g, unknown or other
  misc_feature (204)..(204): n is a, c, g, or t
  modified_base (331)..(331): a, c, t, g, unknown or other
  misc_feature (331)..(331): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctccaggtatcagatgtgacatccagatcgacccagtctccactcctccctgtctgcgtctggtggacnccagacgtccaccgtatcacgttcgccgggcgacgtcaggactaattaaacaacttattagcctaggtactcagacaacgaaaccgaagggtaaactacctaaacgtcctagtactctagtcgtacnctactctacttgactaatcggtacgtcctacctatcgtactacttacgacgtccgggtatacgtaggtctacgggtagggagtacgttagttaccgtacgttccactaacctagtaccacgacctacgccgttacacgtctaaccgtagaacgttacggttaccaacgtttaactacgttaacgtaactaaactaaaggtacttaaccgtcgttacccgtccttacgttacccgttacccggacccgttaggaacctacggttacgttaacgacgtaacccgtaagtcgtacgg

SEQ ID NO: 107353 - DNA, 806 bp, Homo sapiens
  misc_feature: GYAE6OF02H7W2R.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacatccagatcgaccctagtctccactccctccctgtctgtccgtcgtggtcgggacgccagacgtccacctatcctacgttcggccgggcgaggtacaacggactaattaaaccaaacttagtttaacgtccgtaggtactcgaagacaacggaaaaccgaagggtaaacctaacctaaacctccgtagtattctagtggtacgctactccttaacgtttcgactaacgtacggtacggtccctaccctacgttcctacgtacttacgaccggtcgggtacgtaggtacggtacgttacgggtacggggtaaggtacgtttaacgtttaccgtacggttaccctacctaaacccgtacgtaccgtacggtaccgtaacgtccccggtagacccgtaccgtacccgttaaggtaaaccggtttaccggttacttaacccgttttaaacttaacggtttaaaccgttaaacggttaaaacgttaaaaagtttaaccgtaaccgttaaccggtttaccccgtttacccccgttttaccggtttaaacccggtttcccggggtaacccccggtttaaaccggaacccgttttaacggtaacggggttaaaccggttaacccggtaaaaccggttaacccggtaacgggttacggg

SEQ ID NO: 107354 - DNA, 525 bp, Homo sapiens
  misc_feature: GYAE6OF02IVGMC.23.50.E06.1.454.CMB.1.raw
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaagaggcctgggcctcagtgaaggtctcctgcaaggcttctggtacatcttaggactatgctatcaacgtggtgcgacacggcccctggacaagggtcttgagtggagtggggngancgagcgtctagatagataacagagtacttacganacgagtacgttacgaggcagactcncgagtcgagcacgacacncactccacgancacacgtcagagtagtaagtgaacggtatcgtagacagtcgacgacgacgcgtccgtagttatgttgcgtagacgggcggnacgtntcgtagtggttggtgtgacgttcgaggttcgg

SEQ ID NO: 107355 - DNA, 724 bp, Homo sapiens
  misc_feature: GYAE6OF02GJMGY.23.50.E06.1.454.CMB.1.raw
  modified_base (154)..(154): a, c, t, g, unknown or other
  misc_feature (154)..(154): n is a, c, g, or t
  modified_base (206)..(206): a, c, t, g, unknown or other
  misc_feature (206)..(206): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggcctccaggtatcagatgtnacatccagatcgacccagtctccatcctccctgtctgcgttctggtgggacnccagactaccacctactcacgttgggaccggtcgagtacgaacggactaaattaactaacgttagtttacgccgttaggtactacgagaccgtaaacgaaaccgtaaggggtaaaactaacctaaaccttcgtagtactcgtaagtcggtacgacctactacctactttacgacctaacgtcgacggtacctccgtacttcgtacgtacttacggacgggtccggtacgaggttacggtacgtccggtaagggtatacgttactttacgtacgtacctaccgtacgtactcgtaaccgtcgtacgtaccgtgaccctaggtacccgttaacggtaaccggtacggttaacgtaacttaacgtttaaccgttataaacgtaaacgtaaacgttaacttaaccggtaccgtttccgttaacccgtttaccgtttaccggtttacccggaccggtttaccgaaaccgttaaggggtacctaacggttaaacgggaaccctttaacgggtaacgttaccggg

SEQ ID NO: 107356 - DNA, 772 bp, Homo sapiens
  misc_feature: GYAE6OF02HQHDS.23.50.E06.1.454.CMB.1.raw
tcagacgcgagtatcacgaccggtgctcgatttagatctactgacaacacacaaggggacccaaaaaaccacacccctccttgggagaatcccctagatcacagctccgcaccatggactggacctggagcatccttttcttggtggcggcagacaacaggtcgcccactcccaggtcaacgtggaacaatctggagctaggaggtagaaggagggccgtagggggcctacgtaggtagaacggtcttaccgtacggacgaaacggtcgtttacgtacggttaactacgtttacgtttaaggaaacttagtacggtacttaacgtaccgtaaacggtggggtacgaccggtaacgtacccggtaccccgtggaaccggtaacggtcgtttaggaacgggttacggtagggttcgggggtaaggtacgttaccggaacgggtccgtactaaccgggtaagttacggaaacttaaacgaaccgtaacgttacgtttacgaccgaacggaggtaacgtacgaggtacgagtacgtactactataggacgaccgagaacgtacacctacgtccgaagagtaccgagttacgtactacgtaggtacgaagtcggaaggttcgtactagacgtacgtcgtaccggaaacgtcggtaaccgttaccggttaatacgtttaacgtcgggacggaaccggaggtaaaccgggccttaaacgtaccgttcggttacggttaggttggggtaccggttgtacccggtaggtccggttaacggg

SEQ ID NO: 107357 - DNA, 713 bp, Homo sapiens
  misc_feature: GYAE6OF02J07BY.23.50.E06.1.454.CMB.1.raw
  modified_base (218)..(218): a, c, t, g, unknown or other
  misc_feature (218)..(218): n is a, c, g, or t
  modified_base (585)..(585): a, c, t, g, unknown or other
  misc_feature (585)..(585): n is a, c, g, or t
  modified_base (661)..(661): a, c, t, g, unknown or other
  misc_feature (661)..(661): n is a, c, g, or t
tcagacgcgagtatcacgaccggtgctcgatttagatctactgacaacacacaaggggacccaaaaaccacacccctccttgggagaactcccctagatcacagctccgcaccatggactggacctggacgctattcctttttcttgggtgggcggcagcaacagggtcgcccactcccaggttacacgtggaacatcgtggagtctggaggtgaagngggtccgtggggcctacgtaggtggaaggttcctccgtggactaacgggtcgttacgtcggttaacgtacgtacgttttaaggacttaagtcgacttactacgtaacgttgggtacgaccgtaccgtaccgggtcccgttagggaaccgtagggtccgttaggagggtaggtacggtggggttacggacgtacggtcggtacggtcgtaaccggaagtacggtaaacgtaacacggttaacggttacgttaccgagtaaccggtaaagtaaccgggttacggaaggtaccgtaggtacgtactaccgagtcgacgtacgacgacgactaacgactcgacgacgactacgagtacacgtgaaccgtanggaacgtctagtagtcagtcgtacgcgtaacgggtccgttagttacctagttagtcgggtagcgtagggaccggtnaacggtcgtacgtaggttggccgggttgtcggttacgcggttaccggttagg

SEQ ID NO: 107358 - DNA, 988 bp, Homo sapiens
  misc_feature: GYAE6OF02GKS29.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctcctgggactcctgctgctctggctcccgaggtatcagatgtgacactccagatcgaccctagtcctccacttccctccctgtctggcgttcgtggtgggacgcctaggtactaccacctacgtccgtaccgttcgggcccgggtaggaacgtcgaacggtaacttaacgttaaaaccctaaaacttttacgtttaacggtacccttagggtactaccgaacggaaccgtaaaccggaaaaacccgggtaacggggtaaaaaaccgttaaccccgttaaaaaccgtcccgtaagtaacgtttacccttaaaggttcgggttacgtaccttaacggttaccccttaaggttttaccgaacctaaacgttaccggggaaccggggtacccccttaacccttaacgtttcccgtaaccggttacgtttaaccggaccgggttacccgggtacgtacgggtttaaggaaccgggtttccggtaagggggtaaacgttaaaggtttaccgtttttaccggtaccggttaccttaacccgtaacccgtaaggttaaccccaaggggttaccctaaccggtcccgttaaccgggtaccgtaacggtttaccgtaaaacggggttaaaccggttaccggttttaaacggaacccccgttttaaaagggttttaaccctttaaccggttaaccggtttaaaaacgtttaaaaaacgtaccgttaaaaccgggtttaccttaaccccggtttttacccccgtttaacccggtttacccgggttttaacccccgggtaccggttaaacccgggttaaacgttaaccgttaaccgggtttaaaccgggttaaccgtaaacccggtttaaaacgtaacccggttcgggg

SEQ ID NO: 107359 - DNA, 817 bp, Homo sapiens
  misc_feature: GYAE6OF02HR9BM.23.50.E06.1.454.CMB.1.raw
  modified_base (139)..(139): a, c, t, g, unknown or other
  misc_feature (139)..(139): n is a, c, g, or t
  modified_base (676)..(676): a, c, t, g, unknown or other
  misc_feature (676)..(676): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttntggtggcggcagcaacgaggtcgcccactcccaggttacaacgtggaactaatcgtggagctaggaggtgaaggaggccgtggggcctacgaggtaggaacggtctccgtcggacgtaacggtcgttacgttacggttaactacgtttacgttaaggtaacttagtcgtacttatacgtaacggtcgggtcgaccggtaaccgtaccggtacccccgtagggtaaccggtaacgggttcgttaggtaacgggttggggtaacgggttcggggggtagtaacctaccggtacggtaccggtttaccggtaacggtacgttaacggtaaccttaaaccggaacgttaacggttaaccgtttcggaactaaccggttaaggttaaaccggtttcccgggaacggggtactaacgggttaccgttacctaccgaggttacggaaccgaccgtaacgacgtaaccacgtaacgtacccgaacgtacgtaccaacgttaccgtacgtaacgttacggtacggaacgtaggacggtagtaccgngtaacgtactacgtacgtaccgaccgggtcgttaccggttattcgttaacgttcggacgggtaggtacgggtcggaccgtacgtacggttccgttaggtcgggtttgggtccgtaggttccggtcggtacggtttaccggg

SEQ ID NO: 107360 - DNA, 650 bp, Homo sapiens
  misc_feature: GYAE6OF02GJMF8.23.50.E06.1.454.CMB.1.raw
  modified_base (272)..(272): a, c, t, g, unknown or other
  misc_feature (272)..(272): n is a, c, g, or t
  modified_base (358)..(358): a, c, t, g, unknown or other
  misc_feature (358)..(358): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctggagctgaggtgaaggaggccgtggggcctcgagtggaaggtctcctgacaggcttctggttacattctttaggaactatgntatcaacgtgggtcgcgacacggccccgtaggacgaagggtcttggagtggagtggggtggatcgagtcgtctagatagataacanagtacttgacacagtacgtcgaaggcgagtacgtctaccgagtcgagacgacgaacgaacaaccacgtacccgaacgacgaccgtaccgaacgttaccgtaatagtaacgggtaagtagggaagtcgtacgtacgtacgtacgttacgtaccggaaccgaccggtaccgggtacctttaggttaagttttagtcggtcggtacgggagggtacggggaacctaccgtacgttccggtttagggtacgggttcggggttcggtttacgcgggttaccggtggtttaaccgggg

SEQ ID NO: 107361 - DNA, 916 bp, Homo sapiens
  misc_feature: GYAE6OF02IOE3M.23.50.E06.1.454.CMB.1.raw
tcagacgcgagtatcacgaccggtgctcgatttagatctactgacaacacacaagggggcagaagtctctctcagtcaggacacagcatggacatgagggtccctgctcagctccgtggactcctgctgctctggcctcccgaggtactcagtattggtgactactccgagtactcggaacccctagttcctaccctacttcccgttcccttggtccgtgtccggttacgtgggtcgggacgtcccgaaggtacgttccaacctacttccgtaccggttcgggaccccggggtagaacggttcgaaacgggtacctaaactttaaaccgtaaacgtttatttaaccggcccgtttaggtaacgttaccgaacggtaccgaaaacggtaaaacccggtaaacgggggtaaaaaccgttaacccttaaaacccgttcccgttaaggtaacctttacgttacggttacgggttacgaccttaacgttcccgttaacgtttcgaaccgttaacggttaccgtaacgggtccccttacccgtaatttccgtaacgttacgttccggaacggtccggacgttacgggtcggtaacgttacggtacgggtaacgttaacgttactttaccgtaagttcctacccgtaacgtacctaccgagtacccgtaccggtacccacgttaacggtaccgaacgtaacggttaccgttacgtaacgttaacgtttaacgtaccgttaaacgtaaaacttaaacggtaaccgttaacgttaaccggtttccctttaaccccgttttacggttccccgtttttaaccccgggggacctttaacccggggtaaaccgttaagggtttaccggttaaacgggttacccgggttaaaacggttaaaccccgggttaacggtcccgggttaacggg

SEQ ID NO: 107362 - DNA, 757 bp, Homo sapiens
  misc_feature: GYAE6OF02JWLRN.23.50.E06.1.454.CMB.1.raw
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (522)..(522): a, c, t, g, unknown or other
  misc_feature (522)..(522): n is a, c, g, or t
tcagacgcgagtatcacgaccggtgctcgatttagatctactgacaacacacaagggggcagaagtctctctcagtcaggacacagcatggacatggagggtccctgctcagctccgtgggactcctgctgctctggctaccaggtactcagagtgngtacactcgagntcgacccngtcctctactcctcctgtctgcgtctaggtcgggcaccagcgtccaccgtactcgtacgtccggacggcgtacgtcgacggtacaacgttaaaccgtaactacgtttacgtcttggtacttaccgaagtaccaacggtaaaccggtaacggtaaaacggtaccctaacgtttaccgagtactacgtagttacgggatctaaccgtccgtaacgttcgacgtaactcggaccggtcctaccgtacgtaccgtacggtaactccgtaaggccgtacgtacggtagtacgtggaacggttggacgtttagtccgtaagtccggtaccttacggaactcgtaacccggngttaacggtaccgtcgtagacccggtacgtacgtaaacggtacgttacccgaacgtttacgttaacttaccgttaaaagtccgtaaaacgttaaccggtacttaacccggttcccgtttaacccggtcctttaacccgggttacccggtaccggttttaaacgggtaccggttaaccggtttttaaggaaccggttaaaccgggttaccgtaacccgggtttagttaacccgggg

SEQ ID NO: 107363 - DNA, 767 bp, Homo sapiens
  misc_feature: GYAE6OF02HHCEQ.23.50.E06.1.454.CMB.1.raw
  modified_base (128)..(128): a, c, t, g, unknown or other
  misc_feature (128)..(128): n is a, c, g, or t
  modified_base (161)..(161): a, c, t, g, unknown or other
  misc_feature (161)..(161): n is a, c, g, or t
  modified_base (707)..(707): a, c, t, g, unknown or other
  misc_feature (707)..(707): n is a, c, g, or t
tcagacgcgagtatcacgaccggtgctcgatttagatctactgacaacacacaaggggacccaaaaaccacacccctccttgggagaatccctagatcacagctccgcaccatggactggacctggancatccttttctgggtggcggcagcaacgaggtncccactcccaggtttcaactggaactaatctgggagcgttaggaggtagaaggacggtccgtgggggacccttcgagtaggaacggtccttacctggacgaacgggttcctttcgtaggtttaacctagttaccgttttaaggaaccttagtcggtactaataccggaacgttgggggtctccggaaccgtaccggggtcccccttaggggaacggtaacgggttcttaacggggagggttacggggaggtttaggggggtacgtactaccggtacggtaccggttaacggttaacggagttaacgggtaaacttaaaccgaaccggttaacggttaaccgttttaacggacctaaaacgggttacggttaaccggttaacccgggtacggaacgtacgtaacgtcccgttacgaagttcgaacgtacaacgacgacacgtacctaccgagacgactaagtacctacaaccgtagtaacggacggtaggacggtaagtctaacgtacacgtcgacgacgaccgtcggttagtcttagttagtacgnggacggaggacgggtacacggcttacgggtgttcggtggttggtctggtcggtgttcggg

SEQ ID NO: 107364 - DNA, 771 bp, Homo sapiens
  misc_feature: GYAE6OF02FZ35Q.23.50.E06.1.454.CMB.1.raw
  modified_base (144)..(144): a, c, t, g, unknown or other
  misc_feature (144)..(144): n is a, c, g, or t
  modified_base (299)..(299): a, c, t, g, unknown or other
  misc_feature (299)..(299): n is a, c, g, or t
  modified_base (628)..(628): a, c, t, g, unknown or other
  misc_feature (628)..(628): n is a, c, g, or t
  modified_base (679)..(679): a, c, t, g, unknown or other
  misc_feature (679)..(679): n is a, c, g, or t
  modified_base (738)..(738): a, c, t, g, unknown or other
  misc_feature (738)..(738): n is a, c, g, or t
tcagacgcgagtatcacgaccggtgctcgatttagatctactgacaacacacaaggggaccaaaaaccacacccctccttgggagaatccctagatcaacagctccgcaccatggactggacctggagcatcctttttcttggnggcggcagcaacaggtgcccatcccgaggttacaaactggaacaatcgtaggagctaggaggtgaacggagccgtggggcctcgtaagtggaacggtctccgtagcgaaaggtcttacgtaggttacagttacgtttaaggaacttatcgactanacgaaacggttgggtacgacgaacgtaaccgggcccctaggaaccgtaaagggtcgttaggtaacgggttagggtaacgggttcgggggtaaggttaagtaccggtaaaggccgggttaccttaaagggaacgtttaacgaaaacgttaaacccgaaagttacgttaacggtttacgaacctagtaaacggtaacggtttaaccgacggggtacgaacggtaacgttaccgtaccgaaagtcggaaacacgaacctaacggaaaccacgtaactaccgaacgagaacctaagaactacgtaacgtagtacggtaacgtaacgaggtacncgtacgaagtctaacgacgggaacgtaccgtaccggttaccgttaaagttnttacggttgtaacggcggtaagggacgggattacccgaagttccgtaggtttaacgggnggttaccgtagcggttaccggaggtttacgggg

SEQ ID NO: 107365 - DNA, 637 bp, Homo sapiens
  misc_feature: GYAE6OF02ILEVO.23.50.E06.1.454.CMB.1.raw
  modified_base (157)..(157): a, c, t, g, unknown or other
  misc_feature (157)..(157): n is a, c, g, or t
  modified_base (352)..(352): a, c, t, g, unknown or other
  misc_feature (352)..(352): n is a, c, g, or t
tcagacgcgagtatcacgaccggtgctcgatttagatctactgacaacacacaagggggcagaagtctctctcagtcaggacacagcatggacatgagggtccctgctcagctcctgggactcctgctgctctggctcccaggtatcagatgtgacntccagatcgacccagtctccatcctcctgtctgcgtctggtgggacgccagacgtccaacctatccgtacgttcgggccggggcgtagtccgaaggactaattaaacaacttagtttacgccgttaggtatcgacgtacaacggaaaccgaagggtaaacgttacctaaactccgtagacttacttagtaggtanactactcctacttcgactaatcgacggtcctcctacttactcgtatcgagcggtctagggtgactcggtagggaagtagttacttcgagttaccgtacacctactacgacgtacacggtcctacgcgacgtaccgtaggaaaccggttcgttacgaccttaaacttacgttacttaacgtaaactaaacgttactaaccgtcgttaccgtttaccctttacgtcccgtttaccggaccgttaacgaccttaagtcggtaacgtaccggtaacacgtacgttacgg

SEQ ID NO: 107366 - DNA, 642 bp, Homo sapiens
  misc_feature: GYAE6OF02FX4PB.23.50.E06.1.454.CMB.1.raw
  modified_base (194)..(194): a, c, t, g, unknown or other
  misc_feature (194)..(194): n is a, c, g, or t
  modified_base (342)..(342): a, c, t, g, unknown or other
  misc_feature (342)..(342): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttcttggtggcggcagcaacaggtgcccactcccaggttcaactggaacaatctgganctgaggtgaagaggcctggggcctcagtgaaggtctcctgcaaggcttctggttacatccgtttaggaactatgctatacaacgtgggtgcgacacggccccctaggaccgaagggtcttacggaggtggtaggtgggggtgtacgtnaggcgtcgtacgagtagaattaacagagtactttgacaacgagacgttccgaacggggcacggtaagtccgtacctagtacgagcaacgacgtaccgaacaactacccgacggtacgccaacgtacgtaacctaactaggtacggtaacgtagggacggtaatcgagaacctagtcgacgacgaaccggtccgggaccgttaggttactttagtggtaggacggaagggtcgggtacaacgtacgttccgttaggttacggttcgggttacggttcggtacgttgggtacggttaccggg

SEQ ID NO: 107367 - DNA, 875 bp, Homo sapiens
  misc_feature: GYAE6OF02JLK1C.23.50.E06.1.454.CMB.1.raw
  modified_base (204)..(204): a, c, t, g, unknown or other
  misc_feature (204)..(204): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatcctttctggtggcggcagcaacaggtgcccactcccaggttcaactggaacaatctggagctgaggtgaagnggcctggggcctcgagtgaaggtctccgtgcaaggcttcgtggttacattcgttaaggaccttagtcgacgttaactcgtaacgtgggttacgcgaacgtacggcccccgtaaggacgaacggggtccttaggtacggtcggtaaggttcgggggtacgtagtaccgaacggttccgtacgtaacgggtagttcggtaaactaaacgtaccgaaggttacctttaggaccctaacggtaacgtaacggtttacccggaacggggtgtaaacggtaccgttacgtaacccgtaagtgggaacgttacccgaagtaaaccgacccaaacgtacctaaccgaaccggtaacgaccctaaacgtaccgttaaccctaaggtaaccgggtaagtaaacccggttagggacgggttaaccgttcggtaaaccgtaaaccgttacggttaacccggtaacgttaaacccgggacccggttaacccggggtaaccggttttaacgtttaaacccggttttacgttacggggttaccgggaacggggtaacccggggaaacggggttaacccctaaaccggggttaaacggttccccggtttaaacgggttagggggtttacccggggtttcggtttaacgggttccccgggtagggttaaccccgggtttaaccggggg

SEQ ID NO: 107368 - DNA, 799 bp, Homo sapiens
  misc_feature: GYAE6OF02G439H.23.50.E06.1.454.CMB.1.raw
  modified_base (139)..(139): a, c, t, g, unknown or other
  misc_feature (139)..(139): n is a, c, g, or t
  modified_base (261)..(261): a, c, t, g, unknown or other
  misc_feature (261)..(261): n is a, c, g, or t
  modified_base (727)..(727): a, c, t, g, unknown or other
  misc_feature (727)..(727): n is a, c, g, or t
tcagacgcgagtatcacgaccggtgctcgatttagatctactgacaacacacaaggggacccaaaaaccacacccctccttgggagaatcccctagatcacagctccgcaccatggactggacctggagcatccttttnttggtggcggcagcaacgaggtcgcccacgtcccaggttcaactggaacaatctggagctgaggtgaagaggccgtggggcctcgagtggaaggtcctccgtgcaaggctttcgtggtactnttacgtttaggaactatgtacttatacgaacgttgggtcgaccgacgaccggtcccccgtaggacgtaaacggggtcgttagggtaggttgggtacggttaggggggtaggtaaccgtcggtacggtaccggttaccttaaccgggaattacggaaacttaaacggtaaccgaacggtttaccgttttgaaccgaacgaacggttaaaccgtttacgggaccgggtacgtaacggtacgttacccgtacctaggtacggtacgacaccggaaacggtaacccaaccgtacgtacccaccgggtaacgacccgtaaacgtaacgtacgtaacgttaacgtaaccgggtaacggaagttaccgggttacgtaaccgtagtaacccgtgttacccggtagaacccggacggtacggtaccgggtttattacgttgttacggtggaacgggtagggaccggtaaccggtntaccgttaccgggttaggttagggggtttccgttcgggttagggtacgttacggggtcggtttaacccgggg

SEQ ID NO: 107369 - DNA, 284 bp, Homo sapiens
  misc_feature: GYAE6OF01CS74L.12.1.A01.1.454.CMB.1.raw
  modified_base (281)..(284): a, c, t, g, unknown or other
  misc_feature (281)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcgcatagnnnn

SEQ ID NO: 107370 - DNA, 287 bp, Homo sapiens
  misc_feature: GYAE6OF01D374L.12.1.A01.1.454.CMB.1.raw
  modified_base (274)..(274): a, c, t, g, unknown or other
  misc_feature (274)..(274): n is a, c, g, or t
  modified_base (280)..(287): a, c, t, g, unknown or other
  misc_feature (280)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttccgcatctgatacgtcgtatctgagcgggctggcaaggcncatagnnnnnnnn

SEQ ID NO: 107371 - DNA, 289 bp, Homo sapiens
  misc_feature: GYAE6OF01BWKH8.12.1.A01.1.454.CMB.1.raw
  modified_base (283)..(289): a, c, t, g, unknown or other
  misc_feature (283)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnnn

SEQ ID NO: 107372 - DNA, 286 bp, Homo sapiens
  misc_feature: GYAE6OF01EB8JQ.12.1.A01.1.454.CMB.1.raw
  modified_base (282)..(286): a, c, t, g, unknown or other
  misc_feature (282)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcgcatagnnnnn

SEQ ID NO: 107373 - DNA, 287 bp, Homo sapiens
  misc_feature: GYAE6OF01BYEW9.12.1.A01.1.454.CMB.1.raw
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcgcatagnnnnnn

SEQ ID NO: 107374 - DNA, 282 bp, Homo sapiens
  misc_feature: GYAE6OF01BPPR4.12.1.A01.1.454.CMB.1.raw
  modified_base (279)..(282): a, c, t, g, unknown or other
  misc_feature (279)..(282): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttccgcatctgatacgtcgtatctgagcggctggcaaggcgcatagnnnn

SEQ ID NO: 107375 - DNA, 284 bp, Homo sapiens
  misc_feature: GYAE6OF01B77HD.12.1.A01.1.454.CMB.1.raw
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatcttcccgcatctgatacgtcgtatctgagcgggctggcaaggcgcatagnnnnn

SEQ ID NO: 107376 - DNA, 289 bp, Homo sapiens
  misc_feature: GYAE6OF01AVK1X.12.1.A01.1.454.CMB.1.raw
  modified_base (282)..(289): a, c, t, g, unknown or other
  misc_feature (282)..(289): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnnnn

SEQ ID NO: 107377 - DNA, 287 bp, Homo sapiens
  misc_feature: GYAE6OF01D3D2H.12.1.A01.1.454.CMB.1.raw
  modified_base (276)..(276): a, c, t, g, unknown or other
  misc_feature (276)..(276): n is a, c, g, or t
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttccgccatctgatacgtcgtatctgagcgggctggcaaggcncatagnnnnnn

SEQ ID NO: 107378 - DNA, 287 bp, Homo sapiens; identical to SEQ ID NO: 107373
  misc_feature: GYAE6OF01ARJER.12.1.A01.1.454.CMB.1.raw
  modified_base (282)..(287): a, c, t, g, unknown or other
  misc_feature (282)..(287): n is a, c, g, or t

SEQ ID NO: 107379 - DNA, 286 bp, Homo sapiens
  misc_feature: GYAE6OF01DKUP4.12.1.A01.1.454.CMB.1.raw
  modified_base (283)..(286): a, c, t, g, unknown or other
  misc_feature (283)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnn

SEQ ID NO: 107380 - DNA, 285 bp, Homo sapiens
  misc_feature: GYAE6OF01AEW80.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcaccatctgtcttcatcttcccgccatctgatacgtcgtatctgagcgggctggcaaggcgcatagnnnn

SEQ ID NO: 107381 - DNA, 284 bp, Homo sapiens
  misc_feature: GYAE6OF01C37Q0.12.1.A01.1.454.CMB.1.raw
  modified_base (281)..(284): a, c, t, g, unknown or other
  misc_feature (281)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttccgccatctgatacgtcgtatctgagcgggctggcaaggcgcatagnnnn

SEQ ID NO: 107382 - DNA, 282 bp, Homo sapiens
  misc_feature: GYAE6OF01CLPHG.12.1.A01.1.454.CMB.1.raw
  modified_base (272)..(272): a, c, t, g, unknown or other
  misc_feature (272)..(272): n is a, c, g, or t
  modified_base (277)..(282): a, c, t, g, unknown or other
  misc_feature (277)..(282): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgaactgtggctgcacatctgtcttcatctcccgcatctgatacgtcgtatctgagcggctggcaaggcgnatagnnnnnn

SEQ ID NO: 107383 - DNA, 288 bp, Homo sapiens
  misc_feature: GYAE6OF01AZ2C3.12.1.A01.1.454.CMB.1.raw
  modified_base (283)..(288): a, c, t, g, unknown or other
  misc_feature (283)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnn

SEQ ID NO: 107384 - DNA, 281 bp, Homo sapiens
  misc_feature: GYAE6OF01D5DAX.12.1.A01.1.454.CMB.1.raw
  modified_base (278)..(281): a, c, t, g, unknown or other
  misc_feature (278)..(281): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtgagatcaaacgaactgtggctgcaccatctgtcttcatcttccgccatctgatacgtcgtatctgagcggctggcaaggcgcatagnnnn

SEQ ID NO: 107385 - DNA, 291 bp, Homo sapiens
  misc_feature: GYAE6OF01CWQ1S.12.1.A01.1.454.CMB.1.raw
  modified_base (286)..(291): a, c, t, g, unknown or other
  misc_feature (286)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaaacgaactgtggctgcaccatctgtcttcatcttcccgccatctgatacgtcgtatctgagcgggctgggcaaggcgctaatagnnnnnn

SEQ ID NO: 107386 - DNA, 284 bp, Homo sapiens
  misc_feature: GYAE6OF01BCGRI.12.1.A01.1.454.CMB.1.raw
  modified_base (283)..(284): a, c, t, g, unknown or other
  misc_feature (283)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnn

SEQ ID NO: 107387 - DNA, 286 bp, Homo sapiens
  misc_feature: GYAE6OF01CVMOR.12.1.A01.1.454.CMB.1.raw
  modified_base (256)..(256): a, c, t, g, unknown or other
  misc_feature (256)..(256): n is a, c, g, or t
  modified_base (282)..(286): a, c, t, g, unknown or other
  misc_feature (282)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtanctgagcgggctggcaaggcgcatagnnnnn

SEQ ID NO: 107388 - DNA, 286 bp, Homo sapiens
  misc_feature: GYAE6OF01BWDVP.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgagcgggctggcaaggcgcatagnnnnnn

SEQ ID NO: 107389 - DNA, 282 bp, Homo sapiens
  misc_feature: GYAE6OF01C9P78.12.1.A01.1.454.CMB.1.raw
  modified_base (280)..(282): a, c, t, g, unknown or other
  misc_feature (280)..(282): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttccgccatctgatacgtcgtatctgagcgggctggcaaggcgcatagnnn

SEQ ID NO: 107390 - DNA, 290 bp, Homo sapiens
  misc_feature: GYAE6OF01D6PS4.12.1.A01.1.454.CMB.1.raw
  modified_base (283)..(290): a, c, t, g, unknown or other
  misc_feature (283)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnnnn

SEQ ID NO: 107391 - DNA, 288 bp, Homo sapiens; identical to SEQ ID NO: 107383
  misc_feature: GYAE6OF01DTVL0.12.1.A01.1.454.CMB.1.raw
  modified_base (283)..(288): a, c, t, g, unknown or other
  misc_feature (283)..(288): n is a, c, g, or t

SEQ ID NO: 107392 - DNA, 286 bp, Homo sapiens
  misc_feature: GYAE6OF01D79Y0.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcgcatagnnnnnn

SEQ ID NO: 107393 - DNA, 285 bp, Homo sapiens
  misc_feature: GYAE6OF01BIJ6P.12.1.A01.1.454.CMB.1.raw
  modified_base (281)..(285): a, c, t, g, unknown or other
  misc_feature (281)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcgcatagnnnnn

SEQ ID NO: 107394 - DNA, 290 bp, Homo sapiens
  misc_feature: GYAE6OF01EVXNP.12.1.A01.1.454.CMB.1.raw
  modified_base (167)..(167): a, c, t, g, unknown or other
  misc_feature (167)..(167): n is a, c, g, or t
  modified_base (275)..(275): a, c, t, g, unknown or other
  misc_feature (275)..(275): n is a, c, g, or t
  modified_base (278)..(290): a, c, t, g, unknown or other
  misc_feature (278)..(290): n is a, c, g, or t
tcagatacgacgtacacgaccggtgctcgatttagacgtctcatcagggataggaagttattcagcaggcacacaacagaggcagttccagatttcaactgctcatcagcagtctgcaacctgaagattctgcaacttattactgtcaacagagtaacagttacccnccactttcggcggaggaccaaggtggagatcaaacgactgtggctgcaccatctgtcttcatctccgcatctgatactcgtatctgagcggctggcaaggcacatagntannnnnnnnnnnnn

SEQ ID NO: 107395 - DNA, 299 bp, Homo sapiens
  misc_feature: GYAE6OF01B7J5Q.12.1.A01.1.454.CMB.1.raw
  modified_base (283)..(299): a, c, t, g, unknown or other
  misc_feature (283)..(299): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactggtggctgcaccatcgtgtcttcatcttcccgcatctgatacgtcgtatctgagcgggctggcaaggcgcatagnnnnnnnnnnnnnnnnn

SEQ ID NO: 107396 - DNA, 288 bp, Homo sapiens
  misc_feature: GYAE6OF01BI9TQ.12.1.A01.1.454.CMB.1.raw
  modified_base (282)..(288): a, c, t, g, unknown or other
  misc_feature (282)..(288): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnnn

SEQ ID NO: 107397 - DNA, 287 bp, Homo sapiens
  misc_feature: GYAE6OF01EABDL.12.1.A01.1.454.CMB.1.raw
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnn

SEQ ID NO: 107398 - DNA, 284 bp, Homo sapiens
  misc_feature: GYAE6OF01DZWNG.12.1.A01.1.454.CMB.1.raw
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggaaatcagacgaactgtggctgcaccatctgtcttcatcttcccgcatctgatacgtcgtatctgagcgggctggcaaggcgcatagnnnnn

SEQ ID NO: 107399 - DNA, 290 bp, Homo sapiens
  misc_feature: GYAE6OF01BL0YW.12.1.A01.1.454.CMB.1.raw
  modified_base (279)..(290): a, c, t, g, unknown or other
  misc_feature (279)..(290): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttccgcatctgatacgtcgtatctgagcggctggcaaggcgcatagnnnnnnnnnnnn

SEQ ID NO: 107400 - DNA, 285 bp, Homo sapiens
  misc_feature: GYAE6OF01DBMXC.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcgcatagnnnn

SEQ ID NO: 107401 - DNA, 285 bp, Homo sapiens
  misc_feature: GYAE6OF01BGUAF.12.1.A01.1.454.CMB.1.raw
  modified_base (279)..(285): a, c, t, g, unknown or other
  misc_feature (279)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtgagatcaaacgaactgtggctgcaccatctgtcttcatcttccgcatctgatacgtcgtatctgagcgggctggcaaggcgcatagnnnnnnn

SEQ ID NO: 107402 - DNA, 311 bp, Homo sapiens
  misc_feature: GYAE6OF01DSOCD.12.1.A01.1.454.CMB.1.raw
  modified_base (292)..(311): a, c, t, g, unknown or other
  misc_feature (292)..(311): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattacttgtcaacagaagttaacagtttaccctcccactttcggcggaagggaccaaaggtggagatcaaacgaactgtggctgcaccatctgtcttcatccttcccgcatctgatacgtcgtatctgacgcgggtctggcaaggcgcataggnnnnnnnnnnnnnnnnnnnn

SEQ ID NO: 107403 - DNA, 289 bp, Homo sapiens
  misc_feature: GYAE6OF01DRLAC.12.1.A01.1.454.CMB.1.raw
  modified_base (267)..(267): a, c, t, g, unknown or other
  misc_feature (267)..(267): n is a, c, g, or t
  modified_base (283)..(289): a, c, t, g, unknown or other
  misc_feature (283)..(289): n is a, c, g, or t
tcagatacgacgtacacgaccggtgctcgatttagacgtctcatcagggataggaagttattcagcaggcacacaacagaggcagttccagatttcactctcaccatcagcagtctgcaacctgaagattctgcaacttattactgtcaacagagtaacagttaccctcccactttcggcgagggaccaaggtggagatcaaacgactgtggctgcaccatctgtcttcatcttcccgccatcctgatacgtcgtatctgagcgggntggcaaggcgcatagnnnnnnn

SEQ ID NO: 107404 - DNA, 287 bp, Homo sapiens
  misc_feature: GYAE6OF01AXSWH.12.1.A01.1.454.CMB.1.raw
  modified_base (283)..(287): a, c, t, g, unknown or other
  misc_feature (283)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnn

SEQ ID NO: 107405 - DNA, 287 bp, Homo sapiens
  misc_feature: GYAE6OF01CITDA.12.1.A01.1.454.CMB.1.raw
  modified_base (283)..(287): a, c, t, g, unknown or other
  misc_feature (283)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaaacgaactgtggctgcaccatctgtcttcatcttcccgcatctgatacgtcgtatctgagcgggctggcaaggcgcatagnnnnn

SEQ ID NO: 107406 - DNA, 284 bp, Homo sapiens
  misc_feature: GYAE6OF01A9QEB.12.1.A01.1.454.CMB.1.raw
  modified_base (279)..(284): a, c, t, g, unknown or other
  misc_feature (279)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatcttccgcatctgatacgtcgtatctgagcgggctggcaaggcgcatagnnnnnn

SEQ ID NO: 107407 - DNA, 292 bp, Homo sapiens
  misc_feature: GYAE6OF01ANRXR.12.1.A01.1.454.CMB.1.raw
  modified_base (280)..(292): a, c, t, g, unknown or other
  misc_feature (280)..(292): n is a, c, g, or t
tcagatacgacgtacacgaccggtgctcgatttagacgtctcatcagggatagaagttattcagcagacacacaacagaggcagttccagatttcaactgcacatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcggctggcaaggcgcatagnnnnnnnnnnnnn

SEQ ID NO: 107408 - DNA, 286 bp, Homo sapiens
  misc_feature: GYAE6OF01CVFYE.12.1.A01.1.454.CMB.1.raw
  modified_base (273)..(273): a, c, t, g, unknown or other
  misc_feature (273)..(273): n is a, c, g, or t
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgactgtggctgcaccatctgtcttcatcttccgcatctgatacgtcgtatctgagcgggctggcaaggcncaatagnnnnnnn

SEQ ID NO: 107409 - DNA, 283 bp, Homo sapiens
  misc_feature: GYAE6OF01E21HO.12.1.A01.1.454.CMB.1.raw
  modified_base (280)..(283): a, c, t, g, unknown or other
  misc_feature (280)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgactgtggctgcaccatctgtcttcatcttcccgccatctgatacgtcgtatctgagcgggctggcaaggcgcatagnnnn

SEQ ID NO: 107410 - DNA, 283 bp, Homo sapiens
  misc_feature: GYAE6OF01DDOMB.12.1.A01.1.454.CMB.1.raw
  modified_base (281)..(283): a, c, t, g, unknown or other
  misc_feature (281)..(283): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgcatctgatacgtcgtatctgagcgggctggcaaggcgcatagnnn

SEQ ID NO: 107411 - DNA, 282 bp, Homo sapiens
  misc_feature: GYAE6OF01D8FQ3.12.1.A01.1.454.CMB.1.raw
  modified_base (278)..(282): a, c, t, g, unknown or other
  misc_feature (278)..(282): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgactgtggctgcaccatctgtcttcatcttccgcatctgatacgtcgtatctgagcggctggcaaggcgcatagnnnnn

SEQ ID NO: 107412 - DNA, 284 bp, Homo sapiens
  misc_feature: GYAE6OF01EGF1D.12.1.A01.1.454.CMB.1.raw
  modified_base (281)..(284): a, c, t, g, unknown or other
  misc_feature (281)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttccgcatctgatacgtcgtatctgagcgggctggcaaggcgcatagnnnn

SEQ ID NO: 107413 - DNA, 286 bp, Homo sapiens
  misc_feature: GYAE6OF01CXFJ8.12.1.A01.1.454.CMB.1.raw
  modified_base (284)..(286): a, c, t, g, unknown or other
  misc_feature (284)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnn

SEQ ID NO: 107414 - DNA, 486 bp, Homo sapiens
  misc_feature: GYAE6OF01CWGCP.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgctaactttattactgtcaaacagagtaacagttaccctcctacgtttcggcggagggaccaaggtggagatacaaacgactgtggctgacacatctgttacc

SEQ ID NO: 107415 - DNA, 289 bp, Homo sapiens
  misc_feature: GYAE6OF01ERYGK.12.1.A01.1.454.CMB.1.raw
  modified_base (284)..(289): a, c, t, g, unknown or other
  misc_feature (284)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaaacgaactgtggctgcaccatctgtcttcatcttcccgccatctgatacgtcgtatctgagcgggctggcaaggcgcatagnnnnnn

SEQ ID NO: 107416 - DNA, 286 bp, Homo sapiens
  misc_feature: GYAE6OF01EX0ZT.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgctatctgatacgtcgtatctgagcgggctggcaaggcgcatagnnnnnn

SEQ ID NO: 107417 - DNA, 286 bp, Homo sapiens
  misc_feature: GYAE6OF01D9RI1.12.1.A01.1.454.CMB.1.raw
  modified_base (282)..(286): a, c, t, g, unknown or other
  misc_feature (282)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcggctggcaaggcgcatagnnnnn

SEQ ID NO: 107418 - DNA, 282 bp, Homo sapiens
  misc_feature: GYAE6OF01DE751.12.1.A01.1.454.CMB.1.raw
  modified_base (280)..(282): a, c, t, g, unknown or other
  misc_feature (280)..(282): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgactgtggctgcaccatctgtcttcatcttcccgccatctgatacgtcgtatctgagcgggctggcaaggcgcatagnnn

SEQ ID NO: 107419 - DNA, 503 bp, Homo sapiens
  misc_feature: GYAE6OF01BU7OX.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagtattctgctaactttattactgtacaacagacgtaactacgttaccctcctacgtttcggacggagggacccgaaggtcggagacgtacaaacgtaactgtggctgcctaaccg

SEQ ID NO: 107420 - DNA, 286 bp, Homo sapiens; identical to SEQ ID NO: 107379
  misc_feature: GYAE6OF01AKMR5.12.1.A01.1.454.CMB.1.raw
  modified_base (283)..(286): a, c, t, g, unknown or other
  misc_feature (283)..(286): n is a, c, g, or t

SEQ ID NO: 107421 - DNA, 295 bp, Homo sapiens
  misc_feature: GYAE6OF01AGIFX.12.1.A01.1.454.CMB.1.raw
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (286)..(295): a, c, t, g, unknown or other
  misc_feature (286)..(295): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagtagtaacacgttaccctcctacgtttcggcggaggaccaaggtggagatcaaacgactgtggctgcaccatctgtctcactccgttccgccatctgactacgtcgtatcgtgagcggtcngacaggcgnatgcnnnnnnnnnn

SEQ ID NO: 107422 - DNA, 298 bp, Homo sapiens
  misc_feature: GYAE6OF01EP3YF.12.1.A01.1.454.CMB.1.raw
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (280)..(298): a, c, t, g, unknown or other
  misc_feature (280)..(298): n is a, c, g, or t
tcagatacgacgtacacgaccggtgctcgatttagacgtctcatcagggagtagaagttattcaggcaggcacacaacagaggcagttccagatttcaactgctcatcagcagtctgcaacctgaagattcgtgcaacttattactgtcaacagagtaacagttaccctcccactttcggcgagggaccaaggtggagatcaaacgactgtggctgcaccatctgtcttcatcttcccgcatctgatacgtctatcngagcggctggcaaggcncatagnnnnnnnnnnnnnnnnnnn

SEQ ID NO: 107423 - DNA, 285 bp, Homo sapiens
  misc_feature: GYAE6OF01DD51M.12.1.A01.1.454.CMB.1.raw
  modified_base (281)..(285): a, c, t, g, unknown or other
  misc_feature (281)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcgcatagnnnnn

SEQ ID NO: 107424 - DNA, 305 bp, Homo sapiens
  misc_feature: GYAE6OF01D55BS.12.1.A01.1.454.CMB.1.raw
  modified_base (280)..(282): a, c, t, g, unknown or other
  misc_feature (280)..(282): n is a, c, g, or t
  modified_base (284)..(284): a, c, t, g, unknown or other
  misc_feature (284)..(284): n is a, c, g, or t
  modified_base (286)..(305): a, c, t, g, unknown or other
  misc_feature (286)..(305): n is a, c, g, or t
tcagatacgacgtacacgaccggtgctcgatttagacgtctcatcagggagtagaagttattcagcaggcacacaacagaggcagttccagatttcactctcaccatcagcagtctgcaacctgaagattctgcaacttattactgtcaacagagtaacagttaccctcctactttcggcggagggaccaaggtggacgatcaaacgactgtggctgcacatctgtcttcatcttccgcatctgatacgtcgtatctgagcggctggcaaggcgcatagnnntngnnnnnnnnnnnnnnnnnnnn

SEQ ID NO: 107425 - DNA, 533 bp, Homo sapiens
  misc_feature: GYAE6OF01AQ0B2.12.1.A01.1.454.CMB.1.raw
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccaggaaagccctaaggtcctgatctatgctgcatccagtttgcaaagtggggtcccatcaaggttcagtggcagtgggtctgggacagatttcactctacaccatcagcagtctgcaacctgaagattctgactaactttattactagtaccaacagtaacgttaacacgtttaacccctcctaaccgtttccggacgggtacgggacctaagggtggagtaataccgaaacgtaactggtacggctggaccaacctatcttcgttccttacctattccccttcccggcctaacg

SEQ ID NO: 107426 - DNA, 284 bp, Homo sapiens; identical to SEQ ID NO: 107412
  misc_feature: GYAE6OF01AFSS5.12.1.A01.1.454.CMB.1.raw
  modified_base (281)..(284): a, c, t, g, unknown or other
  misc_feature (281)..(284): n is a, c, g, or t

SEQ ID NO: 107427 - DNA, 287 bp, Homo sapiens; identical to SEQ ID NO: 107397
  misc_feature: GYAE6OF01B9F9N.12.1.A01.1.454.CMB.1.raw
  modified_base (282)..(287): a, c, t, g, unknown or other
  misc_feature (282)..(287): n is a, c, g, or t

SEQ ID NO: 107428 - DNA, 285 bp, Homo sapiens
  misc_feature: GYAE6OF01ATBHP.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcgcatagnnnn

SEQ ID NO: 107429 - DNA, 494 bp, Homo sapiens
  misc_feature: GYAE6OF01BH55B.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctggggacagatttcactctcaccatcagcagtctgcaacctgaagattctgacaactttattactgtacaacagagtaactacgttaccctccctacgtttcggcggagggaccaaggtggagactacaaacgaactgtggctcgcaccatcgtgtcc

SEQ ID NO: 107430 - DNA, 286 bp, Homo sapiens
  misc_feature: GYAE6OF01D9FJN.12.1.A01.1.454.CMB.1.raw
  modified_base (276)..(276): a, c, t, g, unknown or other
  misc_feature (276)..(276): n is a, c, g, or t
  modified_base (282)..(286): a, c, t, g, unknown or other
  misc_feature (282)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgccatctgatacgtcgtatctgagcgggctggcaaggcncatagnnnnn

SEQ ID NO: 107431 - DNA, 286 bp, Homo sapiens
  misc_feature: GYAE6OF01BT92F.12.1.A01.1.454.CMB.1.raw
  modified_base (275)..(275): a, c, t, g, unknown or other
  misc_feature (275)..(275): n is a, c, g, or t
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttccgccatctgatacgtcgtatctgagcgggctggcaaggcncatagnnnnnn

SEQ ID NO: 107432 - DNA, 286 bp, Homo sapiens
  misc_feature: GYAE6OF01EX8JI.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttccgccatctgatacgtcgtatctgagcgggctggcaaggcgcatagnnnnnn

SEQ ID NO: 107433 - DNA, 296 bp, Homo sapiens
  misc_feature: GYAE6OF01CV754.12.1.A01.1.454.CMB.1.raw
  modified_base (283)..(296): a, c, t, g, unknown or other
  misc_feature (283)..(296): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccacgtttcggcggagggaccaaggtggagatcaaacgactgtggctgcaccatctgtcttcatctccgcatctgatacgtcgtatctggagcgggctggacaaggcgcaagtagnnnnnnnnnnnnnn

SEQ ID NO: 107434 - DNA, 287 bp, Homo sapiens
  misc_feature: GYAE6OF01CXM3E.12.1.A01.1.454.CMB.1.raw
  modified_base (280)..(287): a, c, t, g, unknown or other
  misc_feature (280)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaactgaagattctgcaacttattactgtcaacagagtaacagttaccctccactttcggcggagggaccaaggtggagatcaaacgaactgtggctgcaccatctgtcttcatcttcccgcatctgatacgtcgtatctgagcgggctggcaaggcgcatagnnnnnnnn

SEQ ID NO: 107435 - DNA, 282 bp, Homo sapiens
  misc_feature: GYAE6OF01COIAL.12.1.A01.1.454.CMB.1.raw
  modified_base (278)..(282): a, c, t, g, unknown or other
  misc_feature (278)..(282): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggaggaccaaggtggagatacaaacgactgtggctgcaccatctgtcttcatctcccgcatctgatacgtcgtatctgagcgggctggcaaggcgcatagnnnnn

SEQ ID NO: 107436 - DNA, 288 bp, Homo sapiens; identical to SEQ ID NO: 107383
  misc_feature: GYAE6OF01A78CP.12.1.A01.1.454.CMB.1.raw
  modified_base (283)..(288): a, c, t, g, unknown or other
  misc_feature (283)..(288): n is a, c, g, or t

SEQ ID NO: 107437 - DNA, 304 bp, Homo sapiens
  misc_feature: GYAE6OF01EN14Z.12.1.A01.1.454.CMB.1.raw
  modified_base (278)..(304): a, c, t, g, unknown or other
  misc_feature (278)..(304): n is a, c, g, or t
tcagatacgacgtacacgaccggtgctcgatttagacgtctcatcagggataggaagttattcagcaggcacacaacagaggcagttccagatttcaactgctcatcagcagtctgcaacctgaagattctgcaacttattactgtcaactagagtaacagttaccctccactttcggcggagggaccaaggtgagatcaaacgactgtggctgcaccatcgtgtctcatcttcccgcatctgatcccgtatctgagcggtctggcaaggcgcatagnnnnnnnnnnnnnnnnnnnnnnnnnnn

SEQ ID NO: 107438 - DNA, 284 bp, Homo sapiens
  misc_feature: GYAE6OF01BEQD0.12.1.A01.1.454.CMB.1.raw
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgaactgtggctgcaccatctgtcttcatcttccgccatctgatacgtcgtatctgagcgggctggcaaggcgcatagnnnnn

SEQ ID NO: 107439 - DNA, 289 bp, Homo sapiens; identical to SEQ ID NO: 107371
  misc_feature: GYAE6OF01B2X52.12.1.A01.1.454.CMB.1.raw
  modified_base (283)..(289): a, c, t, g, unknown or other
  misc_feature (283)..(289): n is a, c, g, or t

SEQ ID NO: 107440 - DNA, 284 bp, Homo sapiens
  misc_feature: GYAE6OF01BFTC0.12.1.A01.1.454.CMB.1.raw
  modified_base (279)..(284): a, c, t, g, unknown or other
  misc_feature (279)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttccgcatctgatacgtcgtatctgagcggctggcaaggcgcatagnnnnnn

SEQ ID NO: 107441 - DNA, 574 bp, Homo sapiens
  misc_feature: GYAE6OF01A93YY.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaacgcccctaaggtcctgatctatgctgcatccagtttgacgtaaagtcggggtacccagtcaaggttcaggtgcgagtgggtctgggacaggtatttcacttctcacatcagcagtctgactaaccgtagaacgtatttctagtactaactttagtttactagttacaaacagtaacgttaaacctaccgtttaacccctaccctaacggtttccgggaaccgggtacgggaacccgtaaggggtacggaagtaactacggaaaacgtacgttaggtcggactacggacctaccgtacttccgttggttaccc

SEQ ID NO: 107442 - DNA, 300 bp, Homo sapiens
  misc_feature: GYAE6OF01BZL98.12.1.A01.1.454.CMB.1.raw
  modified_base (285)..(300): a, c, t, g, unknown or other
  misc_feature (285)..(300): n is a, c, g, or t
tcagatacgacgtacacgaccggtgctcgatttagacgtctcatcagggatagaagttattcagcaggctacacaacagaggtacagttccagatttcaactgctcatcagcagtctgcaacctgaagattctggcaacttattactgtcaacagagtaacagttaccctcccactttcggcggagggtaccaaggtggagatcaaacgaactgtggctgcaccatctgtcttcatcttccgccatctgatacgtcgtatctgagcggctggcaaggcgcatagnnnnnnnnnnnnnnnn

SEQ ID NO: 107443 - DNA, 282 bp, Homo sapiens
  misc_feature: GYAE6OF01EB0EG.12.1.A01.1.454.CMB.1.raw
  modified_base (274)..(274): a, c, t, g, unknown or other
  misc_feature (274)..(274): n is a, c, g, or t
  modified_base (280)..(282): a, c, t, g, unknown or other
  misc_feature (280)..(282): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccctactttcggcggaggaccaaggtggagatacaaacgaactgtggctgcacatctgtcttcatcttccgcatctgatacgtcgtatctgagcggctggcaaggcncatagnnn

SEQ ID NO: 107444 - DNA, 287 bp, Homo sapiens
  misc_feature: GYAE6OF01DUTIW.12.1.A01.1.454.CMB.1.raw
  modified_base (283)..(287): a, c, t, g, unknown or other
  misc_feature (283)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcaccatctgtcttcatccttcccgcatctgattacgtcgttcctgagcggctggcaaggcgcaagtgnnnnn

SEQ ID NO: 107445 - DNA, 286 bp, Homo sapiens
  misc_feature: GYAE6OF01BGUYJ.12.1.A01.1.454.CMB.1.raw
  modified_base (282)..(286): a, c, t, g, unknown or other
  misc_feature (282)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnn

SEQ ID NO: 107446 - DNA, 280 bp, Homo sapiens
  misc_feature: GYAE6OF01EGE2U.12.1.A01.1.454.CMB.1.raw
  modified_base (277)..(280): a, c, t, g, unknown or other
  misc_feature (277)..(280): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtggagatcaaacgactgtggctgcaccatctgtcttcatcttccgcatctgatacgtcgtatctgagcggctggcaaggcgcatagnnnn

SEQ ID NO: 107447 - DNA, 284 bp, Homo sapiens
  misc_feature: GYAE6OF01C1HSC.12.1.A01.1.454.CMB.1.raw
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccacttcggcggaggaccaaggtggagatcaaacgaactgtggctgcaccatctgtcttcatccttccgccatctgatacgtcgtatctgagcgggctggcaaggcgcatagnnnnn

SEQ ID NO: 107448 - DNA, 480 bp, Homo sapiens
  misc_feature: GYAE6OF01BH9HU.12.1.A01.1.454.CMB.1.raw
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
tcagatacgacgtacacgaccggtgctcgatttagacgtctcatcagggggcaggagtcagtctcagtcaggacacagcatggacatgagggtcccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagattttacnctcaccatcagcagtctgcaacctgaagnttcngctaacttatactgtcaacagataacagttaccctccactttcggcgagggaccaggtggagntacaaagactgtggcngcactacg

SEQ ID NO: 107449 - DNA, 284 bp, Homo sapiens
  misc_feature: GYAE6OF01C3U1F.12.1.A01.1.454.CMB.1.raw
  modified_base (282)..(284): a, c, t, g, unknown or other
  misc_feature (282)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatacaaacgaactgtggctgcaccatctgtcttcatcttccgccatctgatacgtcgtatctgagcgggctggcaaggcgcatagnnn

SEQ ID NO: 107450 - DNA, 488 bp, Homo sapiens
  misc_feature: GYAE6OF01BUZGJ.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaagttcagtggcagtgggtctgggacagagttcactctcaccatcagcagcctgcagcctgaagatgttgctaacttattactgtacaaaagttataacagtcgccccttcacccttacggaccgaaggaccacggctaggagattacgacgaactgtggctcg

SEQ ID NO: 107451 - DNA, 521 bp, Homo sapiens
  misc_feature: GYAE6OF01AKPPB.12.1.A01.1.454.CMB.1.raw
  modified_base (336)..(336): a, c, t, g, unknown or other
  misc_feature (336)..(336): n is a, c, g, or t
  modified_base (387)..(387): a, c, t, g, unknown or other
  misc_feature (387)..(387): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcaggtgggtntggggacagatttcactctcaccatcagcagtctgcaacctgaagtattcngctaacgtttattactgtacaacagtaacgtaactacgttaccctcctacgtttcgggacggtacgggacctaagggtagagataccgaaacggtaactggttacggctacggccaaccattccgtgttacccg

SEQ ID NO: 107452 - DNA, 493 bp, Homo sapiens
  misc_feature: GYAE6OF01DTMRZ.12.1.A01.1.454.CMB.1.raw
  modified_base (486)..(486): a, c, t, g, unknown or other
  misc_feature (486)..(486): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccaggaaagcccctaaggtcctgatctatgctgcatccagtttgcaaagtgggtccatcaaggttcagtgcagtggtctgggacagatttcactctcaccatcagcagtctgcaactgaagtattctgcaactttattactgtacaacagagtaactacgttaccctccctacgtttcggcgtagggaccaaggtggagactacgaaacgtacctaggtgactcgactacatntgttacc

SEQ ID NO: 107453 - DNA, 287 bp, Homo sapiens
  misc_feature: GYAE6OF01CAMML.12.1.A01.1.454.CMB.1.raw
  modified_base (283)..(287): a, c, t, g, unknown or other
  misc_feature (283)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaaacgaactgtggctgcaccatctgtcttcatcttcccgcatctgatacgtcgtatctggagcgggctggcaaggcgcatagnnnnn

SEQ ID NO: 107454 - DNA, 305 bp, Homo sapiens
  misc_feature: GYAE6OF01ED8ZF.12.1.A01.1.454.CMB.1.raw
  modified_base (283)..(284): a, c, t, g, unknown or other
  misc_feature (283)..(284): n is a, c, g, or t
  modified_base (286)..(287): a, c, t, g, unknown or other
  misc_feature (286)..(287): n is a, c, g, or t
  modified_base (289)..(305): a, c, t, g, unknown or other
  misc_feature (289)..(305): n is a, c, g, or t
tcagatacgacgtacacgaccggtgctcgatttagacgtctcatcagggagtagaagttattcagcaggcacacaacagaggcagttccagatttcactctcaccatcagcagtctgcaacctgaagattctgcaacttattactgtcaacagagtaacagttaccctcccatttcggcggagggaccaaggtggagatcaaacgaacgtgtggctgcaccatctgtcttcatcttcccgcatctgatacgtcgtatctgagcgggctggcaaggcgcatagnncnngnnnnnnnnnnnnnnnnn

SEQ ID NO: 107455 - DNA, 312 bp, Homo sapiens
  misc_feature: GYAE6OF01DZYU2.12.1.A01.1.454.CMB.1.raw
  modified_base (305)..(312): a, c, t, g, unknown or other
  misc_feature (305)..(312): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgacacatctgtctcacttcctcccgactatcgtagtacgttacgtacgttatcgtgacgggccggtcgtcggacgaaggccgactagtagnnnnnnnn

SEQ ID NO: 107456 - DNA, 288 bp, Homo sapiens
  misc_feature: GYAE6OF01BX9TZ.12.1.A01.1.454.CMB.1.raw
  modified_base (282)..(288): a, c, t, g, unknown or other
  misc_feature (282)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcgcatagnnnnnnn

SEQ ID NO: 107457 - DNA, 291 bp, Homo sapiens
  misc_feature: GYAE6OF01A0ZPH.12.1.A01.1.454.CMB.1.raw
  modified_base (283)..(291): a, c, t, g, unknown or other
  misc_feature (283)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcgcatagnnnnnnnnn

SEQ ID NO: 107458 - DNA, 291 bp, Homo sapiens
  misc_feature: GYAE6OF01BB122.12.1.A01.1.454.CMB.1.raw
  modified_base (196)..(196): a, c, t, g, unknown or other
  misc_feature (196)..(196): n is a, c, g, or t
  modified_base (284)..(291): a, c, t, g, unknown or other
  misc_feature (284)..(291): n is a, c, g, or t
tcagatacgacgtacacgaccggtgctcgatttagacgtctcatcagggatagaagttattcagcaggcacacaacagagtcagttccagatttcactctcaccatcagcagtctgcaacctgaagattctgcaacttattactgtcaacagagtaacagttaccctccactttcggcggagggaccaaggtgganatacaaacgactgtggctgacaccatctgtctcatcctccgcatctgatacgtcgtatctgaggcggtctggacaagggcacagtagnnnnnnnn

SEQ ID NO: 107459 - DNA, 295 bp, Homo sapiens
  misc_feature: GYAE6OF01C7W59.12.1.A01.1.454.CMB.1.raw
  modified_base (151)..(151): a, c, t, g, unknown or other
  misc_feature (151)..(151): n is a, c, g, or t
  modified_base (285)..(295): a, c, t, g, unknown or other
  misc_feature (285)..(295): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacngagtaacagtttaccctcccactttcggcggagggaccaaggtggagatcaaaacggactgtggctgcaccatctgtcttcatcttcccgcatcctgatacgtcgtatctgagcgggctggcaaggcgcatagnnnnnnnnnnn

SEQ ID NO: 107460 - DNA, 492 bp, Homo sapiens
  misc_feature: GYAE6OF01DO9DE.12.1.A01.1.454.CMB.1.raw
  modified_base (486)..(486): a, c, t, g, unknown or other
  misc_feature (486)..(486): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagtattctgactaactttattactgtcaaacagaagtaacacgttaccctccctactttcggctgacgggaccaaggtggaagatacaaacgactgtaggctagcaccntcgtcg

SEQ ID NO: 107461 - DNA, 284 bp, Homo sapiens
  misc_feature: GYAE6OF01CZ8RV.12.1.A01.1.454.CMB.1.raw
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatctcccgcatctgatacgtcgtatctgagcgggctggcaaggcgcatagnnnnn

SEQ ID NO: 107462 - DNA, 286 bp, Homo sapiens
  misc_feature: GYAE6OF01D8SFP.12.1.A01.1.454.CMB.1.raw
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgaactgtggctgcaccatctgtcttcatcttccgccatctgatacgtcgtatctgagcgggctggcaaggcgcatagnnnnnnn

SEQ ID NO: 107463 - DNA, 302 bp, Homo sapiens
  misc_feature: GYAE6OF01BJOFA.12.1.A01.1.454.CMB.1.raw
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (287)..(302): a, c, t, g, unknown or other
  misc_feature (287)..(302): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtggagatacgaaacgacgtgtggctgcaccatcgtgtcttacacgtcctccgcctatctgatacgtcgtatctgagcggntgacaggcganactagnnnnnnnnnnnnnnnn

SEQ ID NO: 107464 - DNA, 378 bp, Homo sapiens
  misc_feature: GYAE6OF01A0NUH.12.1.A01.1.454.CMB.1.raw
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (294)..(295): a, c, t, g, unknown or other
  misc_feature (294)..(295): n is a, c, g, or t
  modified_base (304)..(306): a, c, t, g, unknown or other
  misc_feature (304)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (313)..(378): a, c, t, g, unknown or other
  misc_feature (313)..(378): n is a, c, g, or t
tcagatacgacgtacacgaccggtgctcgatttagacgtctcatcagggataggaagttattcagcaggcacacaacagaggcagttccagatttcaactgctcatcagcagtctgcaacctgaagattctgcaacttattactgtcaacagagtaacagttacccctcccacttttcgggcggagggacccaagggtggagatcaaaacgaactgtggctgcaccatctgtctcatccttccgcatctgatactcgtatctgaggcggctggcaaggcanactagncngncgnngcatgcagnnntnancgnnnnnnnnnnnnnnnnnnnnnnnnnnnnnnnnnnnnnnnnnnnnnnnnnnnnnnnnnnnnnnnnnn

SEQ ID NO: 107465 - DNA, 285 bp, Homo sapiens
  misc_feature: GYAE6OF01A3N36.12.1.A01.1.454.CMB.1.raw
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcgcatagnnnn

SEQ ID NO: 107466 - DNA, 287 bp, Homo sapiens
  misc_feature: GYAE6OF01C2FO1.12.1.A01.1.454.CMB.1.raw
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagattttcactctcaccatcagcagtctgcaacctgagattctgcaacttattactgtcaacagagtaacagttaccctcccactttcggcggagggaccaaggtggagatcaaacgaactgtggctgcaccatctgtcttcatcttccgcatctgattacgtcgtatctgagcgggctggcaaggcgcatagnnnnnn

SEQ ID NO: 107467 - DNA, 309 bp, Homo sapiens
  misc_feature: GYAE6OF01DM398.12.1.A01.1.454.CMB.1.raw
  modified_base (281)..(309): a, c, t, g, unknown or other
  misc_feature (281)..(309): n is a, c, g, or t
tcagatacgacgtacacgaccggtgctcgattttagacgtctcatcagggagtagaagttattcagcaggcacacaacagaggcagttccagatttcaactgctcatcagcagtctgcaacctgaagattctgcaacttattactgtcaacagagtaacagttaccctccactttcggcgagggaccaaggtggagatcaaacgaactgtggctgcaccatctgtcttcatcttccgcatctgatacgtcgtatctgagcgggctggcaaggcgcagtagnnnnnnnnnnnnnnnnnnnnnnnnnnnnn

SEQ ID NO: 107468 - DNA, 287 bp, Homo sapiens
  misc_feature: GYAE6OF01B6L9U.12.1.A01.1.454.CMB.1.raw
  modified_base (276)..(276): a, c, t, g, unknown or other
  misc_feature (276)..(276): n is a, c, g, or t
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcncatagnnnnnn

SEQ ID NO: 107469 - DNA, 300 bp, Homo sapiens
  misc_feature: GYAE6OF01BOOKP.12.1.A01.1.454.CMB.1.raw
  modified_base (292)..(300): a, c, t, g, unknown or other
  misc_feature (292)..(300): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtacaacagagtaacagttaccctcctactttcgggcggagggaccaaggtggagatacaaacgaactgtggctgcaccatctgtcttcactccttcccgcctatctgatacgtcgtatctgaggcgggctgggacaaggcgcatagnnnnnnnnn

SEQ ID NO: 107470 - DNA, 302 bp, Homo sapiens
  misc_feature: GYAE6OF01C15YY.12.1.A01.1.454.CMB.1.raw
  modified_base (285)..(302): a, c, t, g, unknown or other
  misc_feature (285)..(302): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacggactgtggctgacaccatctgtcttcatccttcccgcatctgatacgtcgtatctgacgcgggctggcaaggcgcatagnnnnnnnnnnnnnnnnnn

SEQ ID NO: 107471 - DNA, 294 bp, Homo sapiens
  misc_feature: GYAE6OF01ETZJU.12.1.A01.1.454.CMB.1.raw
  modified_base (284)..(294): a, c, t, g, unknown or other
  misc_feature (284)..(294): n is a, c, g, or t
tcagatacgacgtacacgaccggtgctcgatttagacgtctcatcagggataggaagttattcagcaggcacacaacagaggcagttccagatttcactctcaccatcagccagtctgcaacctgaagattctgcaacttattactgtcaacagagtaacagttacccctcccactttcggcggagggaccaaggtggagatcaaacgactgtggctgcaccatctgtcttcatcttccgcatctgatacgtcgtatctgacgcggctggacaaggcgcatagnnnnnnnnnnn

SEQ ID NO: 107472 - DNA, 525 bp, Homo sapiens
  misc_feature: GYAE6OF01ACBP6.12.1.A01.1.454.CMB.1.raw
  modified_base (260)..(260): a, c, t, g, unknown or other
  misc_feature (260)..(260): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (490)..(490): a, c, t, g, unknown or other
  misc_feature (490)..(490): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcttctgtcggagacagagtcaccatcacttgccaggcgagtgaggacattcggaaatttttaatggtttcagcagaaccagggaaanccctagactcctgattcacgaggcatccaattcggaataggggtcccagaaggttcaggtggaggtggagctgggacagtactttacccnaccatcagcagcctgcagcctgaagntctgcaactatattactgtacaanagtaataataatctaccgtactacttttcggacctaggggaccaaggccgtaggaacgataccgaaacgtacgtaggtgcgtcgacaccntctgttcttacacttccgttcccgtcctagtaccg

SEQ ID NO: 107473 - DNA, 286 bp, Homo sapiens
  misc_feature: GYAE6OF01DA5Z0.12.1.A01.1.454.CMB.1.raw
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttccgcatctgatacgtcgtatctgagcgggctggcaaggcgcatagnnnnnnn

SEQ ID NO: 107474 - DNA, 554 bp, Homo sapiens
  misc_feature: GYAE6OF01C1MQ8.12.1.A01.1.454.CMB.1.raw
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaaggtgggtcccatcaaggtcagtggcagtgggtctgggacagatttcactctcaccatcagcagtctgaccaaccgtgaagtatttccgtagacctaactttattactgtacaacagaacgtaactacgttacccctccctaacgtttccgggacgggacgggaaccaagggtaggacgtaacgtaaccgaaaacgtacgtggtacggtccgtaggacctacctacgttcgttacgttccttaccactttcccctccccgtcctaacg

SEQ ID NO: 107475 - DNA, 514 bp, Homo sapiens
  misc_feature: GYAE6OF01BOFGW.12.1.A01.1.454.CMB.1.raw
  modified_base (371)..(371): a, c, t, g, unknown or other
  misc_feature (371)..(371): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaaattggtatcagcagaaaaccagggaaacgccccgtaaaggtcctagatctatgctgcatcagtttgcaaagtgggccatcaaggttcaggtgcaggtggtcgtgggacagtatttcactctcaccatcagcagtcngacactagaagtacttctagctaacttattactacgtacaactagaacgtaactacgttacccctcctaacggttcggacggaggaacccgaggtacggagagtacaaacgtacgtggtagacgtcgacaccattctgttacc

SEQ ID NO: 107476 - DNA, 526 bp, Homo sapiens
  misc_feature: GYAE6OF01DP67Z.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccaggaaacgcccctaaggtcctgatctatgctgcatcctagtttgacaaaggtcggggtcccagtcaaggttcagtggcaggtgggtcgtgggacagtatttcactctcaccatcagcagtctgacaacctagaagtattctagactaactttattactgtacaacagtaacgtaactacgttacccctccctacgtttccggacggacgggaccgaagggtggagtaacgtacgaaacgtactggtggctcgaccaccacttctcgttacc

SEQ ID NO: 107477 - DNA, 576 bp, Homo sapiens
  misc_feature: GYAE6OF01D5MRH.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaatttaaatgtatcagcaagaaaccagggaaacgcccctaaggtcctgactctatgctgctatcctagtttcgacgtaaaggtcggggtacccagtacgaaggttcaggtggctaggtgggtctgggactagtatttcactctcacctatcagctagtctgactaacctgaacgtattctagtactaactttattactgtacaactagtaacgttaactaccgtttacccctacccgtacgtttaccgggaccgggtaacgggtaaccgtaaggggtacggtaacggtaacgtaaccgaaaacggtaacgttaggtacggtactcgaccgtaacccg

SEQ ID NO: 107478 - DNA, 583 bp, Homo sapiens
  misc_feature: GYAE6OF01DCT61.12.1.A01.1.454.CMB.1.raw
tcagatacgacgtacacgaccggtgctcgatttagacgtctcatcagggggagtctcagtcaggacacagcatggacatgagggtccccgctcagctcctgggggctcctgctactctggctccgaggtgccagatgtgacatccagatgacccagtctccatccctccctgtctgcatctgtagcagacagagtcaccatcacttgccgggcaagtcagaccatcagcagcttaatttaaattggtaatcgaagacaaggaaaaccgagggaaacgcccccgtaaaggtccctagatctatgctgcatccagtttgactaaaggtcgggtaccatacgaaggttcaggtggctaggtgggtctagggactagtattcaactctacaccatcgagctagtctacgaccaacctggaactcttcgacgtacttaactttactttaacgagtaccaagaacgtacgtaaaccttaccttaccctcccgttaccgtttcggaccgttaggacgggaacccgtaagggtacggtaagaacgtacgaaaaccggttcgtggtacgtctacgaccactgttccgttacg

SEQ ID NO: 107479 - DNA, 525 bp, Homo sapiens
  misc_feature: GYAE6OF01E0CTK.12.1.A01.1.454.CMB.1.raw
  modified_base (258)..(258): a, c, t, g, unknown or other
  misc_feature (258)..(258): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaaattgtatcagcagaaacaggaancccctaaggtcctgatctatgctgcatcctagtttgactaaaggtcgggtacccagtacgaaggtttcaggtggcgtagtggggtcgtggggacagtatttcactctcaccatcagctagtctgaccaactgaagtattctgactaacttattactgtacaacaagacgtaactacgttaccctcctaccgttcggacggtaacggaccgaaggtggaagtacgtaacaaacgtacgtggtacgcgtacgacacctatcgtgttacc

SEQ ID NO: 107480 - DNA, 283 bp, Homo sapiens
  misc_feature: GYAE6OF01EBWS7.12.1.A01.1.454.CMB.1.raw
  modified_base (276)..(283): a, c, t, g, unknown or other
  misc_feature (276)..(283): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggaggaccaaggtgagatcaaacgactgtggctgcaccatctgtcttcatcttccgcatctgatacgtcgtatctgagcgggctggcaaggcgcatagnnnnnnnn

SEQ ID NO: 107481 - DNA, 629 bp, Homo sapiens
  misc_feature: GYAE6OF01DGFSL.12.1.A01.1.454.CMB.1.raw
  modified_base (164)..(164): a, c, t, g, unknown or other
  misc_feature (164)..(164): n is a, c, g, or t
  modified_base (224)..(224): a, c, t, g, unknown or other
  misc_feature (224)..(224): n is a, c, g, or t
  modified_base (368)..(368): a, c, t, g, unknown or other
  misc_feature (368)..(368): n is a, c, g, or t
  modified_base (454)..(454): a, c, t, g, unknown or other
  misc_feature (454)..(454): n is a, c, g, or t
tcagatacgacgtacacgaccggtgctcgatttagacgtctcatcgaggggggcaggagtcagtctcagtcaggacacagcatggacatgagggtcccgctcagctcctggggctcctgctactctggctccgaggtgccagatgtgacatccagatgaacccngtctccatcctcctgtctgcatctgtagcgagacaggacgtcaccatccacttgccgggnaagtcagaccatcagcagtacttaatttaaatcggtatcgagacaagaaaccgtagggaaacgccccgtaagggtcctaggattcgtatagacctagctatccgagtttagactaaaggtcgggtacccatcgaaggttcaggnggacgtgtcgggtcagggactaggtactttcaacttctaccactatacaggactagtctacgacctaacgtagaacgtattacganaccttaaacgtttattaacggtcgttacaaacgtaggtaaaccgtttaacctaccgttaaccccttacccgtaacggtttaccgggaaccgggtaaacgggaacccgtaaggggtacgggaaactaaccgtaaccgaaaacggtaacttgggtacggtccgtagcccgtaaaccg

SEQ ID NO: 107482 - DNA, 288 bp, Homo sapiens; identical to SEQ ID NO: 107383
  misc_feature: GYAE6OF01B30IE.12.1.A01.1.454.CMB.1.raw
  modified_base (283)..(288): a, c, t, g, unknown or other
  misc_feature (283)..(288): n is a, c, g, or t

SEQ ID NO: 107483 - DNA, 296 bp, Homo sapiens
  misc_feature: GYAE6OF01BXE6Q.12.1.A01.1.454.CMB.1.raw
  modified_base (283)..(296): a, c, t, g, unknown or other
  misc_feature (283)..(296): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcctatctgatacgtcgtatctgacgcgggctggcaggcgcatagnnnnnnnnnnnnnn

SEQ ID NO: 107484 - DNA, 520 bp, Homo sapiens
  misc_feature: GYAE6OF01E0WL0.12.1.A01.1.454.CMB.1.raw
  modified_base (394)..(394): a, c, t, g, unknown or other
  misc_feature (394)..(394): n is a, c, g, or t
  modified_base (510)..(510): a, c, t, g, unknown or other
  misc_feature (510)..(510): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgacaaaggtcggggtacccagtcaaggtttcaggtggcgaggtgggtctggggacaggtatttcactctacacatcagcagtctgacaacctgaagnttctgactaactttattactgtacaacagacgtaacacgtttaccctcctacgtttcgggacggtagggacctaagggtcggaacgtatacgaaacgacgtgtggctcgacacctntcgtgttacc

SEQ ID NO: 107485 - DNA, 536 bp, Homo sapiens
  misc_feature: GYAE6OF01CNS2L.12.1.A01.1.454.CMB.1.raw
  modified_base (404)..(404): a, c, t, g, unknown or other
  misc_feature (404)..(404): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcacatcacttgccgggcaagtcagaccatcagcagctaatttaaattggtatcagcagaaaccagggaaagcccctaaggtcctgatctatgctgcatcctagtttgactaaaggtcggggtacccagtacaagggtttcaggttggcgaggtgggtctggggactagtagtttcactctcaccattcagtcagttctgacaaccgtgaatnttctgactaactttattactagtacaacagtagtaaacctcgttaacccctccgtaaccgttcgggacggtaggaccgaggtggagactacgaaacgtcgtagtacggctacggacaccgtatcgtgttacc

SEQ ID NO: 107486 - DNA, 286 bp, Homo sapiens
  misc_feature: GYAE6OF01B8Z8N.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatccttccgccatctgatacgtcgtatctgagcggctggcaaggcgcatagnnnnnn

SEQ ID NO: 107487 - DNA, 757 bp, Homo sapiens
  misc_feature: GYAE6OF01CQVCC.12.1.A01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagatacgacgtacacgaccggtgctcgatttagacgtctcatcagggggcagggagtcagtctcagtcaggacacagcatggacatgagggtccccgctcagctcctggggctcctgctactctggctccgaggtgccagatgtgacatccagatgacccagtctccatccctccctgtctgcatctgancagacagagtccacatcacttgccggnaagtcagaccatacagcagacttaatttaaattggtatacagacaagaaaccgaacgggaaacgaccccgtaaggtcctagatctaatgctgactataccagtttacgacgtaaaggtcggggtaccaagtacgtaaggttacaaggtggacgtaggtcgggttacggtagggaacctaagtactttaccactactaccaccaacttccgaagtacctaggtttaccctacggaacctaaaccgtacggtaaagttaacgtttacctaacggtaaccgttaaaacgtttaactttaaccgttacgggttaaaccaaaaccgtaaacggttaaacgtttaaaaccccgttaacccggttttaaaccccccttacccggttaaccgggttttaaaacggggtacccggggtaaaaacgggggaaaccccgttaaaaagggggttacggaaaacggtaaaccggttaaaacccggttaaaaaccggtaaaccggtttacggggtaacgggtaaccgttaccggaacccgtttaaaccccgg

SEQ ID NO: 107488 - DNA, 279 bp, Homo sapiens
  misc_feature: GYAE6OF01E4F2J.12.1.A01.1.454.CMB.1.raw
  modified_base (276)..(279): a, c, t, g, unknown or other
  misc_feature (276)..(279): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggaggaccaaggtggagatcaaacgactgtggctgcaccatctgtcttcatcttcccgcatctgacgtcgtatctgagcgggctggcaaggcgcatagnnnn

SEQ ID NO: 107489 - DNA, 307 bp, Homo sapiens
  misc_feature: GYAE6OF01C0S5E.12.1.A01.1.454.CMB.1.raw
  modified_base (290)..(307): a, c, t, g, unknown or other
  misc_feature (290)..(307): n is a, c, g, or t
tcagatacgacgtacacgaccggtgctcgatttagacgtctcatcagggatagaagttattcagcaggcacacaacagaggcagttccagatttcactctcaccatcagcagtctgacaacctgaagattctgctaactttattactgtacaacagtagtaacagttacccctcctacgtttcggcggaaggaccaaggtggagatacaaaacgactgtggctgcacatctgtctcactctccgctatctgatcgtcgtatctagacgcggatggacaaggctcaagtgnnnnnnnnnnnnnnnnnn

SEQ ID NO: 107490 - DNA, 284 bp, Homo sapiens
  misc_feature: GYAE6OF01CJ7BW.12.1.A01.1.454.CMB.1.raw
  modified_base (222)..(222): a, c, t, g, unknown or other
  misc_feature (222)..(222): n is a, c, g, or t
  modified_base (279)..(284): a, c, t, g, unknown or other
  misc_feature (279)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcacatcngtctcatcttccgcatctgatacgtcgtatctgagcgggctggcaaggcgctatagnnnnnn

SEQ ID NO: 107491 - DNA, 500 bp, Homo sapiens
  misc_feature: GYAE6OF01C2AWE.12.1.A01.1.454.CMB.1.raw
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (496)..(496): a, c, t, g, unknown or other
  misc_feature (496)..(496): n is a, c, g, or t
tcagatacgacgtacacgaccggtgctcgatttagacgtctcatcaggggagtctcagtcaggacacagcatggacatgagggtccccgctcagctcctggggctcctgctactctgtctccgaggtgccagatgtgacatccagatgacccagtctccatccctccctgtctgcatctgtagcagacagagtcaccatcacttggccggcaagtcagaccatcagcagctatttaaatggtatcagcagaaaccaggaaagcccctaaggtcctgatctatgctgcatccagtttgactaaaggtcgggtaccatcaaggttcagtggcagtgggtctgggacaggatttcactctacacatcagcagtctacgactaacctagaacgtattcgtgactaacttattactgtacaacagaacgtaactacgtacccctctaacgttcggacgaggtaccgaggtaggagtacagaaacngtgngctgacacactntgtc

SEQ ID NO: 107492 - DNA, 294 bp, Homo sapiens
  misc_feature: GYAE6OF01AWNP4.12.1.A01.1.454.CMB.1.raw
  modified_base (281)..(294): a, c, t, g, unknown or other
  misc_feature (281)..(294): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgagcgggctggcaaggcgcatagnnnnnnnnnnnnnn

SEQ ID NO: 107493 - DNA, 565 bp, Homo sapiens
  misc_feature: GYAE6OF01BGKM7.12.1.A01.1.454.CMB.1.raw
  modified_base (368)..(368): a, c, t, g, unknown or other
  misc_feature (368)..(368): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccggcaagtcagaccatcagcagctatttaaattggtatcagcagaaaccagggaaacgcccctaaggtcctgatctatgctgcatccagtttgacgaaagtcggggtacccagtcgaaggttcagtggcaggtgggtcgtgggacagtatttcactctcaccntcagcagtctgcaacctgaagtattctgtactaactttattactgtacaaactagtaacgtaacctacgttacccctaccctacggtttccgggacgggtaacgggaccgtaaagggtacggaacgtacgttaaccgaaaacggtaacgttgggtacggtaccgttacgaccgtaacctacgttccgtggtttaccc

SEQ ID NO: 107494 - DNA, 286 bp, Homo sapiens
  misc_feature: GYAE6OF01D9Z4R.12.1.A01.1.454.CMB.1.raw
  modified_base (277)..(286): a, c, t, g, unknown or other
  misc_feature (277)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactgtggctgcacatctgtctcatcctccgcatctgatacgtcgtatctgagcggctggacaaggcgcatagnnnnnnnnnn

SEQ ID NO: 107495 - DNA, 281 bp, Homo sapiens
  misc_feature: GYAE6OF01CPQXF.12.1.A01.1.454.CMB.1.raw
  modified_base (271)..(271): a, c, t, g, unknown or other
  misc_feature (271)..(271): n is a, c, g, or t
  modified_base (277)..(281): a, c, t, g, unknown or other
  misc_feature (277)..(281): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaattatactgtcaacagagtaacagttaccctccattcggcgaggaccaaggtggagatcaaacgaactgtggctgcaccatctgtcttcatcttcccgcatcctgatacgtcgtatctgagcgggctggccaaggcgntatagnnnnn

SEQ ID NO: 107496 - DNA, 548 bp, Homo sapiens
  misc_feature: GYAE6OF01D8EBF.12.1.A01.1.454.CMB.1.raw
  modified_base (211)..(211): a, c, t, g, unknown or other
  misc_feature (211)..(211): n is a, c, g, or t
  modified_base (264)..(264): a, c, t, g, unknown or other
  misc_feature (264)..(264): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgcccgggnaagtcagaccatcagcagctatttaaattggtatcagcagaaaccagggaaancccctaaggtcctgatctatgctgcatccagtttgcaaagtcggggtccagtcaaggttcagtggcaggtgggtctgggacagtattcactctcaccatcagcagtcngacaacctgaagtnttcgtgtacctaatttactttactgttacaaacagtaacgtaaacctacgtttacccctcccgtaacgtttccgggacggtaagggaccgtaaagggtcggaagtaacgtacgaaacggtacgtggtacggaccgttcgactaccctagttcctggttaccc

SEQ ID NO: 107497 - DNA, 293 bp, Homo sapiens
  misc_feature: GYAE6OF01EGPHT.12.1.A01.1.454.CMB.1.raw
  modified_base (277)..(293): a, c, t, g, unknown or other
  misc_feature (277)..(293): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtgagatcaaacgactgtggctgcaccatctgtcttcatccttcccgcatctgatacgtctatctgagcggctggcaaggcgcatagnnnnnnnnnnnnnnnnn

SEQ ID NO: 107498 - DNA, 284 bp, Homo sapiens
  misc_feature: GYAE6OF01DORU4.12.1.A01.1.454.CMB.1.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (276)..(284): a, c, t, g, unknown or other
  misc_feature (276)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagtttaccctccactttcggcggaggaccaaggtggagatcaaacgactgtggctgcacatctgtctnatcttccgcatctgatacgtcgtatctgagcggntggcaggcganatagnnnnnnnnn

SEQ ID NO: 107499 - DNA, 293 bp, Homo sapiens
  misc_feature: GYAE6OF01C8HMK.12.1.A01.1.454.CMB.1.raw
  modified_base (282)..(293): a, c, t, g, unknown or other
  misc_feature (282)..(293): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtatctgacgcgggctggcaaggcgcatagnnnnnnnnnnnn

SEQ ID NO: 107500 - DNA, 286 bp, Homo sapiens
  misc_feature: GYAE6OF01END9I.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtggctgcaccatctgtcttcatcttcccgccatctgatacgtcgtatctgagcggctggcaaggcgcatagnnnnnn

SEQ ID NO: 107501 - DNA, 289 bp, Homo sapiens; identical to SEQ ID NO: 107371
  misc_feature: GYAE6OF01A153P.12.1.A01.1.454.CMB.1.raw
  modified_base (283)..(289): a, c, t, g, unknown or other
  misc_feature (283)..(289): n is a, c, g, or t

SEQ ID NO: 107502 - DNA, 290 bp, Homo sapiens
  misc_feature: GYAE6OF01EOR2C.12.1.A01.1.454.CMB.1.raw
  modified_base (277)..(277): a, c, t, g, unknown or other
  misc_feature (277)..(277): n is a, c, g, or t
  modified_base (284)..(290): a, c, t, g, unknown or other
  misc_feature (284)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatctgatacgtcgtatctgagcgggctggcaaggcncagtagnnnnnnn

SEQ ID NO: 107503 - DNA, 489 bp, Homo sapiens
  misc_feature: GYAE6OF01BVRXR.12.1.A01.1.454.CMB.1.raw
  modified_base (276)..(276): a, c, t, g, unknown or other
  misc_feature (276)..(276): n is a, c, g, or t
  modified_base (284)..(287): a, c, t, g, unknown or other
  misc_feature (284)..(287): n is a, c, g, or t
  modified_base (289)..(289): a, c, t, g, unknown or other
  misc_feature (289)..(289): n is a, c, g, or t
  modified_base (293)..(294): a, c, t, g, unknown or other
  misc_feature (293)..(294): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (457)..(457): a, c, t, g, unknown or other
  misc_feature (457)..(457): n is a, c, g, or t
  modified_base (464)..(465): a, c, t, g, unknown or other
  misc_feature (464)..(465): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (482)..(483): a, c, t, g, unknown or other
  misc_feature (482)..(483): n is a, c, g, or t
  modified_base (485)..(485): a, c, t, g, unknown or other
  misc_feature (485)..(485): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgactacgtcgtatctgagcgggctggcaaggcncatacggnnnnanctannactgncnacgtnagtcatgcangactgcatcggtatcgacncgtatacgtgacgtcgcagtacngtacacgtacgtactntcgtacgtacgtacgtacgtactacgtactacgtacgtacgtacgtacgtcgtacgtagtacgagacgtacgtacgtacgtancgtgtcnnctcncgtnactctactnngngtcg

SEQ ID NO: 107504 - DNA, 288 bp, Homo sapiens; identical to SEQ ID NO: 107383
  misc_feature: GYAE6OF01CO9YY.12.1.A01.1.454.CMB.1.raw
  modified_base (283)..(288): a, c, t, g, unknown or other
  misc_feature (283)..(288): n is a, c, g, or t

SEQ ID NO: 107505 - DNA, 287 bp, Homo sapiens; identical to SEQ ID NO: 107373
  misc_feature: GYAE6OF01BKIZT.12.1.A01.1.454.CMB.1.raw
  modified_base (282)..(287): a, c, t, g, unknown or other
  misc_feature (282)..(287): n is a, c, g, or t

SEQ ID NO: 107506 - DNA, 529 bp, Homo sapiens
  misc_feature: GYAE6OF01D2Z20.12.1.A01.1.454.CMB.1.raw
  modified_base (263)..(263): a, c, t, g, unknown or other
  misc_feature (263)..(263): n is a, c, g, or t
  modified_base (403)..(403): a, c, t, g, unknown or other
  misc_feature (403)..(403): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcaagaaaccagggaacncccctaaggtcctgactctatgctgcatccgtagtttgacgtaaaggtcgggtacccagtcaaggttcagtggactaggtgggtctgggacagtattcactcacaccatacagctagtctgaccaactagaatacttacngtactaattatactgtacaacagtataactacgttacccctcctacgttcgctaggacgggtaccgaagggtggaacgtagtacgaaaacgtacgtagtacggacctacgacctaactcgtcttcg

SEQ ID NO: 107507 - DNA, 367 bp, Homo sapiens
  misc_feature: GYAE6OF01BQUY8.12.1.A01.1.454.CMB.1.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (283)..(285): a, c, t, g, unknown or other
  misc_feature (283)..(285): n is a, c, g, or t
  modified_base (289)..(290): a, c, t, g, unknown or other
  misc_feature (289)..(290): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (298)..(299): a, c, t, g, unknown or other
  misc_feature (298)..(299): n is a, c, g, or t
  modified_base (303)..(305): a, c, t, g, unknown or other
  misc_feature (303)..(305): n is a, c, g, or t
  modified_base (307)..(309): a, c, t, g, unknown or other
  misc_feature (307)..(309): n is a, c, g, or t
  modified_base (311)..(367): a, c, t, g, unknown or other
  misc_feature (311)..(367): n is a, c, g, or t
tcagatacgacgtacacgaccggtgctcgatttagacgtctcatcagggataggaagttattcagcaggcacacaacagaggcagttccagatttcaactgctcatcagcagtctgcaacctgaagattctgcaacgttattactgtcaaactagagtaacagtttacccctccacttttcgggcggagggaccaagggtgagatcgaaacgactgtggctgcnccatctgtctnatctccgcatcngatctcgtatctgagcggctggacaaggcacatagnnnagtnngnagngcnnagtnnncnnntnnnnnnnnnnnnnnnnnnnnnnnnnnnnnnnnnnnnnnnnnnnnnnnnnnnnnnnnn

SEQ ID NO: 107508 - DNA, 286 bp, Homo sapiens; identical to SEQ ID NO: 107445
  misc_feature: GYAE6OF01BHDD7.12.1.A01.1.454.CMB.1.raw
  modified_base (282)..(286): a, c, t, g, unknown or other
  misc_feature (282)..(286): n is a, c, g, or t

SEQ ID NO: 107509 - DNA, 287 bp, Homo sapiens
  misc_feature: GYAE6OF01EQMKQ.12.1.A01.1.454.CMB.1.raw
  modified_base (158)..(158): a, c, t, g, unknown or other
  misc_feature (158)..(158): n is a, c, g, or t
  modified_base (261)..(261): a, c, t, g, unknown or other
  misc_feature (261)..(261): n is a, c, g, or t
  modified_base (278)..(287): a, c, t, g, unknown or other
  misc_feature (278)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacngttaccctcccatttcggcggaggaccaaggtggagatcaaacgactgtggctgcaccatctgtcttcatcttccgcatctgatacgtcgtatctgagcgggntggcaaggccgcatagnnnnnnnnnn

SEQ ID NO: 107510 - DNA, 286 bp, Homo sapiens
  misc_feature: GYAE6OF01C8EAK.12.1.A01.1.454.CMB.1.raw
  modified_base (282)..(286): a, c, t, g, unknown or other
  misc_feature (282)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatccttcccgcatctgatacgtctatctgagcgggctggcaaggcgcatagnnnnn

SEQ ID NO: 107511 - DNA, 275 bp, Homo sapiens
  misc_feature: GYAE6OF01C5133.12.1.A01.1.454.CMB.1.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaaacagagtaacagttaccctccactttcggcgaggaccaaggtggagatcaaacgaactgtggctgcacatctgtcttcatcttccgcatctgatacgtctatctgancgggctggcaaggcnatgn

SEQ ID NO: 107512 - DNA, 288 bp, Homo sapiens
  misc_feature: GYAE6OF01CQTWV.12.1.A01.1.454.CMB.1.raw
  modified_base (283)..(288): a, c, t, g, unknown or other
  misc_feature (283)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaaacgaactgtggctgcaccatctgtcttcatcttcccgcatctgatacgtcgtatctgagcgggctggcaaggcgcatagnnnnnn

SEQ ID NO: 107513 - DNA, 353 bp, Homo sapiens
  misc_feature: GYAE6OF01BX5R6.12.1.A01.1.454.CMB.1.raw
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(353): a, c, t, g, unknown or other
  misc_feature (298)..(353): n is a, c, g, or t
tcagatacgacgtacacgaccggtgctcgatttagacgtctcatcagggagttaggaagttattcacgcaggcacacaacagaggcagttccagatttcactctcaccatcgagcagtctgcaacctgaagattctgcaacttattactgtcaacagagtaacagttaccctcccactttcggcggagggacccaaggtggagatcaaaacgaactgtgtctgcaccatctgtcttcatcttcccgccatctgatacgtcgtatctgagcgggctggcaaggcgacaagtagncancnnnnnnnnnnnnnnnnnnnnnnnnnnnnnnnnnnnnnnnnnnnnnnnnnnnnnnnn

SEQ ID NO: 107514 - DNA, 285 bp, Homo sapiens
  misc_feature: GYAE6OF01CSXA2.12.1.A01.1.454.CMB.1.raw
  modified_base (281)..(285): a, c, t, g, unknown or other
  misc_feature (281)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgcatctgatacgtcgtatctgagcgggctggcaaggcgcatagnnnnn

SEQ ID NO: 107515 - DNA, 286 bp, Homo sapiens
  misc_feature: GYAE6OF01D0BMW.12.1.A01.1.454.CMB.1.raw
  modified_base (284)..(286): a, c, t, g, unknown or other
  misc_feature (284)..(286): n is a, c, g, or t
tcagatacgacgtacacgaccggtgctcgatttagacgtctcatcagggatagaagttattcagcaggcacacaacagaggcagttccagatttcactctaaccatcagcagtctgcaacctgaagattctgcaacttattactgtcaacagagtaacagttacccctcccactttcggcggagggaccaaggtggagatacaaacgactgtggctgcaccatctgtcttcatcttctcgccatctgatacgtcgtatctgagcgggctggcaaggcgcatagnnn

SEQ ID NO: 107516 - DNA, 693 bp, Homo sapiens
  misc_feature: GYAE6OF01D1QZK.12.1.A01.1.454.CMB.1.raw
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctcctgtctgcatctgtagcagacagagtcaccatcacttggccgggacaagtcagaccatcagctagcttattaaatggtatcagcaagaaaccgagggaaancccctaaaggtcctagatacttangctgctactaccgtggtttcaaccgtaaagggttcggggtaccctaagttccgaaaggtttccgaaggttggacgtagggttcgggtcttgggggtaaccaaggttactttctaaccctgttaccaacccattccgaacgtcgtaagtcctaccgggtactaaacccgttaggtaaacggtctttacgtacgtaaccttaaaccgttttacttaacttcggtaaacccaaagtaaacgggtaacctaaaccgttaacccggttaacccctttaaccctaaccgggttttaccgggaccgggttaaggggaacccgtttagggaaccggtagtaacgtaaacccgaaacggttaaatccgggttagtccggtaacctcggaaacctctaacgttgtttaaccc

SEQ ID NO: 107517 - DNA, 285 bp, Homo sapiens; identical to SEQ ID NO: 107393
  misc_feature: GYAE6OF01DZFIF.12.1.A01.1.454.CMB.1.raw
  modified_base (281)..(285): a, c, t, g, unknown or other
  misc_feature (281)..(285): n is a, c, g, or t

SEQ ID NO: 107518 - DNA, 551 bp, Homo sapiens
  misc_feature: GYAE6OF01A5YSY.12.1.A01.1.454.CMB.1.raw
  modified_base (219)..(219): a, c, t, g, unknown or other
  misc_feature (219)..(219): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagctatttaattgtatcagcagaaaccagggaaagcccctaaggtcctgatctatgctgcatccagtttgacgtaaaggtcggggtacccagtcaaggtttcagtggctaggtgggtcgtgggactagtatttcactctcaccatcagcagtctcgctaacctgaagtacttctagacctaaactttacttaccgtagtaccaaacgtaagtaacgtaactacgttacccctcccgtacgtttccgggacggtacgggacctaagggtcggaaggtactacgaaaaccgtaacgttacggtggactggcctaaccg

SEQ ID NO: 107519 - DNA, 536 bp, Homo sapiens
  misc_feature: GYAE6OF01CF37C.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagccatcagcagctaatttaaattggtatcagcagaaaccagggaaacgcccctaaggtcctgatctatgctgcatccagtttgactaaaggtcgggtccagtcgaaggttcagtggcagtgggtctgggacagtatttcactctcacatcagcagtctgacaacctgaagtattctagactaactttattactagtacaactaagtaacgtaactacgttacccctcccgtacgtttcgggacggtacggaccgtaagggtagagactacgaaaacggtacgtcggtagggacctcgactaacctagttcttgttacccg

SEQ ID NO: 107520 - DNA, 287 bp, Homo sapiens
  misc_feature: GYAE6OF01A6HDB.12.1.A01.1.454.CMB.1.raw
  modified_base (282)..(287): a, c, t, g, unknown or other
  misc_feature (282)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcgcatagnnnnnn

SEQ ID NO: 107521 - DNA, 290 bp, Homo sapiens
  misc_feature: GYAE6OF01BLLRK.12.1.A01.1.454.CMB.1.raw
  modified_base (279)..(290): a, c, t, g, unknown or other
  misc_feature (279)..(290): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgactgtgctgcaccatctgtcttcatcttcccgcatctgatacgtcgtatctgagcgggctggcaaggcgcatagnnnnnnnnnnnn

SEQ ID NO: 107522 - DNA, 761 bp, Homo sapiens
  misc_feature: GYAE6OF01CMT8U.12.1.A01.1.454.CMB.1.raw
  modified_base (214)..(214): a, c, t, g, unknown or other
  misc_feature (214)..(214): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatcgacccagtctccatcctccctgtctgcatctgtagcagacagatcaccatcacgttcggccggganaaggtcaacgaccatcagcagtacttaatttaaatggtatcaagacaacgaaaaccgaagggaaaccgccccgtaaaggtcctagtacttctacgtgccgttggactaacttccgtaaggttttcgaacgtaaaagggttccggggtaccctaacgtaacggtaaacggtttcggacggttagggtaccgaagggttcggggtcgtaacggggtaactaggtttacctttacaccttacttaccgaaccctagttccgaacgtccaacggttcccttacggaacctaaacccgttaggaaagttacctttcgtaacgtacttaaaccgttttattaacgtcgtaaacctaacgtaacggtaacgttaaaccgttaccccgttaaacccctttacccgttaacccggtttaccggggaaccggggttaaacgggtaacccggtaaaaggggttacggaaacggtaaccgtaaacgaaaacgggttaacgtacgggttacggtaccgtaccggtaacccaaccgttaacgttcccgttacggtttaccc

SEQ ID NO: 107523 - DNA, 715 bp, Homo sapiens
  misc_feature: GYAE6OF01DCKTN.12.1.A01.1.454.CMB.1.raw
  modified_base (225)..(225): a, c, t, g, unknown or other
  misc_feature (225)..(225): n is a, c, g, or t
tcagatacgacgtacacgaccggtgctcgatttagacgtctcatcagggggcaggagtcagtctcagtcaggacacagcatggacatgacggtcccgctcagctcctggggctcctgctactctggctccgaggtgccagatgtgacatccagatcgacccagtctccatcctcctgtctgcatctgtagcagacagacgtccaccatccacgttcggccggganaagtcacgaccatcagcagtacttaatttaaagttggtactacgaagacaaacggaaaccgaacggggaaacctaccccgttaaaggttcctaggtacttacgtaatcggcttagacctacttaccgtagtttacgacgtaaacgggttccggggtaccctaagtaccggtaaacggttcgaggtcggtacgtagggttcgggtacgtagggactagttacttcacttcaccacgtatcgacgactacgttctacgaacctaaccgtagtaacgttactttccgtagtaacctttaacttttacgttaacttacggtaaactaacgtaacggttaaacgttaacccgttacccgtttaacccccttacccggttaccgggttaccggggaaccgggtaaacggggtaaccggtaaggggtaacggacgttaaaccggtaaccgtaaaacgggttacgttacgggtaccgtaccgttaacgcccttaaccg

SEQ ID NO: 107524 - DNA, 508 bp, Homo sapiens
  misc_feature: GYAE6OF01ES7JW.12.1.A01.1.454.CMB.1.raw
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtaccatcaaggttcagtggctagtgggtctgggacagtatttcacttctacacctatcagcagtctgcaacctgaatattcagctaacttnttactgtacaactagactaacacgttacccncctacgtttccggacggacgggtaccaagggtcggagaacgtacaaaacgtactgtaggctgcctaaccg

SEQ ID NO: 107525 - DNA, 286 bp, Homo sapiens
  misc_feature: GYAE6OF01D59O6.12.1.A01.1.454.CMB.1.raw
  modified_base (274)..(274): a, c, t, g, unknown or other
  misc_feature (274)..(274): n is a, c, g, or t
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttccgccatctgatacgtcgtatctgagcggctggcaaggcncatagnnnnnnn

SEQ ID NO: 107526 - DNA, 293 bp, Homo sapiens
  misc_feature: GYAE6OF01CFGI5.12.1.A01.1.454.CMB.1.raw
  modified_base (285)..(293): a, c, t, g, unknown or other
  misc_feature (285)..(293): n is a, c, g, or t
tcagatacgacgtacacgaccggtgctcgatttagacgtctcatcagggataggaagttattcagcaggcacacaacagaggcagttccagatttcaactgctcatcagcagtctgcaacctgaagattctgcaacttattactgtcaacagagtaacagttaccctccctactttcggcggagggaccaaggtggagatacaaacgactgtggctgcacatctgtcttcatcttcccgcatctgatacgtctatcgtagagcgggctggcgaaggcgcagtagnnnnnnnnn

SEQ ID NO: 107527 - DNA, 284 bp, Homo sapiens
  misc_feature: GYAE6OF01B6EQ0.12.1.A01.1.454.CMB.1.raw
  modified_base (281)..(284): a, c, t, g, unknown or other
  misc_feature (281)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcgcatagnnnn

SEQ ID NO: 107528 - DNA, 283 bp, Homo sapiens
  misc_feature: GYAE6OF01BW4CN.12.1.A01.1.454.CMB.1.raw
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (279)..(283): a, c, t, g, unknown or other
  misc_feature (279)..(283): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggaggaccaaggtggagatcaaaacgactgtggctgcacatctgtcttcatcttccgcatctagatacgtcgtatctgagcgggntggcaaggcncatagnnnnn

SEQ ID NO: 107529 - DNA, 535 bp, Homo sapiens
  misc_feature: GYAE6OF01ERPN4.12.1.A01.1.454.CMB.1.raw
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (510)..(510): a, c, t, g, unknown or other
  misc_feature (510)..(510): n is a, c, g, or t
tcagatacgacgtacacgaccggtgctcgatttagacgtctcatcagggggtaggtcgtcagtcaggacaccacgcatggacatgagggtccccgctcagctccgtggggctcctgctactctggctccgaggtgccagatgtgacatccagatgacccagtctccatccctccctgtctgcatctgtagcagacagagtcaccatcacttgccgggcaagtcagaccatcagcagctatttaaattggtatcagcaagaaaaccagggaaacgccccctaaaggtcctagatctatgctagcatccagtttgacgtaaagtggggtaccccatacgaaggttcaggtggcaggtgggtctgggacagtatttcactctccacatccagcagtctgctaacctagaatattcagtctaactttnttactntacaanagactaactacgttacccctcctactttacgggacggagggaccgtaaggtgaacgtatacaaacgtactaggngtacgtacgaccatcttcgtgttcc

SEQ ID NO: 107530 - DNA, 594 bp, Homo sapiens
  misc_feature: GYAE6OF01D9MQO.12.1.A01.1.454.CMB.1.raw
  modified_base (403)..(403): a, c, t, g, unknown or other
  misc_feature (403)..(403): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaatttaattgtatcagcaagaaaccgagggaaacgccccctaaggtcctagatctatgctgcattccagtttgacgtaaaggtcgggtcccagtacgtaaggttcaggtggcaggtgggtcgtagggactagtattcactctcacatcagctagtctacgactaactgaagtnttactagtacctaactttacttactgtacaacgtagaacgtaacgtaccgtttaacccctacccgtacgtttaccgggacggtaacgggtacccgtaaagggtacgggaagtaaacgtaaccggaaaaccggttacggtacgggtacggtaccgtaccggtaacctaaccgtaacgttccgtcgttacccg

SEQ ID NO: 107531 - DNA, 541 bp, Homo sapiens
  misc_feature: GYAE6OF01AHTQN.12.1.A01.1.454.CMB.1.raw
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaatgtatcagcagaaccagggaaagcccctaaggtcctgatctatgctgcatcctagtttgcgtaaagtcgggtacccatcaaggtttcagtggcaggtgggtctgggacagtatttcnctctcacatcagcagtctgacctaacctgaatnttctacgtctaactttattactgtactaacagtataacctaccgttacccctcccttaccgtttaccgggaccgggtaagggtaacccgtaagggttaggacgtaactaaccgaaacggtaaccgtggtacggcctgccctaaccg

SEQ ID NO: 107532 - DNA, 507 bp, Homo sapiens
  misc_feature: GYAE6OF01EJM2O.12.1.A01.1.454.CMB.1.raw
  modified_base (377)..(377): a, c, t, g, unknown or other
  misc_feature (377)..(377): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccaggaaagttccacacctcctgatctatgctgcatccgctttgcatcaggggtcccatctcgttcagcgcagtgatcgtgggacagagttcactctcacatcagcacgcctgcngctcgaagacgttgtgactaacgttacttacttagtaactaaagtaataacacgtaccgtccccttactacccgttacggacgtaaacgggaccacgacgtaggaacgtaagttacggacgtaagtcggg

SEQ ID NO: 107533 - DNA, 284 bp, Homo sapiens
  misc_feature: GYAE6OF01ET5N9.12.1.A01.1.454.CMB.1.raw
  modified_base (274)..(274): a, c, t, g, unknown or other
  misc_feature (274)..(274): n is a, c, g, or t
  modified_base (280)..(284): a, c, t, g, unknown or other
  misc_feature (280)..(284): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactgtggctgcaccatctgtcttcatcttcccgccatctgatacgtcgtatctgagcggctggcaaggcncatagnnnnn

SEQ ID NO: 107534 - DNA, 654 bp, Homo sapiens
  misc_feature: GYAE6OF01BALSK.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctgggctcctgctactctggctccgaggtgccagatgtgacatccagatgacccagtctccatcctccctgtctgcatctgtagcagacagagtcaccatcacttgccggcaagtcagaccatcagcatacttatttaaattggtatcagacaagaaaccaggaaacgcccgtaaggtcctgatctatgctgacatcctagtttgacgtaaacggtcggggtacccagtacgtaaggttcgaggtggcgtagggtgggtacgtagggactagtagttttacacttcctaccaaccgtacttcgaacgtacctaggtccctacgacctaaccgttagtaacgtactttctacgtaccttaaactttacgtttaacctagttaacctaaacgtaagtaacgttaaaccgtaccgtttaacccccttacccgtaccggtttaccgggaccgggttaaacggggtaaccggtaaaggggtacggaaacggtaacgttaaacccgtaaaacggtaacgttacgggtaccggtacgtacggtaccctaaacccg

SEQ ID NO: 107535 - DNA, 287 bp, Homo sapiens
  misc_feature: GYAE6OF01B508M.12.1.A01.1.454.CMB.1.raw
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttccgccatctgatacgtcgtatctgagcgggctggcaaggcgcatagnnnnnnn

SEQ ID NO: 107536 - DNA, 285 bp, Homo sapiens
  misc_feature: GYAE6OF01C31TL.12.1.A01.1.454.CMB.1.raw
  modified_base (279)..(285): a, c, t, g, unknown or other
  misc_feature (279)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggaggaccaaggtggagatcaaacgactgtaggctgcaccatctgtcttcatcttccgccatctgatacgtcgtatctgagcggactggcaaggcgcatagnnnnnnn

SEQ ID NO: 107537 - DNA, 287 bp, Homo sapiens; identical to SEQ ID NO: 107520
  misc_feature: GYAE6OF01EKCKZ.12.1.A01.1.454.CMB.1.raw
  modified_base (282)..(287): a, c, t, g, unknown or other
  misc_feature (282)..(287): n is a, c, g, or t

SEQ ID NO: 107538 - DNA, 350 bp, Homo sapiens
  misc_feature: GYAE6OF01DJ7OD.12.1.A01.1.454.CMB.1.raw
  modified_base (228)..(228): a, c, t, g, unknown or other
  misc_feature (228)..(228): n is a, c, g, or t
  modified_base (306)..(307): a, c, t, g, unknown or other
  misc_feature (306)..(307): n is a, c, g, or t
  modified_base (309)..(350): a, c, t, g, unknown or other
  misc_feature (309)..(350): n is a, c, g, or t
tcagatacgacgtacacgaccggtgctcgattttagacgtctcatcagggatagaaggttattcagcaggcacacaacagaggcagttccacgatttcactctcaccattcagcagtctgcaacctgaagattctgcaactttattactgtcaacagagtaacagttaccctcccacttttcgggcggagggaccaaggtcggagatacaaacgactgtgctgcactntctgtcttcacttccttcccgactattctgtactacgtcgtatcgtaggacggccggctcggacgaggccacgtatgnngnnnnnnnnnnnnnnnnnnnnnnnnnnnnnnnnnnnnnnnnnn

SEQ ID NO: 107539 - DNA, 614 bp, Homo sapiens
  misc_feature: GYAE6OF01B7CC5.12.1.A01.1.454.CMB.1.raw
  modified_base (220)..(220): a, c, t, g, unknown or other
  misc_feature (220)..(220): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatcacttgccgggnaagtcagaccatcagcagctaatttaaatggtatcagcaagaaaccagggaaacgccccgtaaggtcctagatctatgctgcatcctagtttgactaaaggtcggggtacccagtacgtaaggtttcaaggtggacgtagggtcggggtcgtgggaactaggtactttcacttcctacaccatcagctagtcctagacctaactagaacgtatttcgtagtacctaaactttacttaacctggtaacctaaacgagtaaacgttaacccgtaacgttacccccttacccgtaaccgtttccggggaccgggtaacgggtaaccgtaaaggggtagggaacgtaacgtaaccgaaaacggtaaccgttagggtaggccgtacggaccgtaacccg

SEQ ID NO: 107540 - DNA, 286 bp, Homo sapiens
  misc_feature: GYAE6OF01CUJ1N.12.1.A01.1.454.CMB.1.raw
  modified_base (280)..(286): a, c, t, g, unknown or other
  misc_feature (280)..(286): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggaggaccaaggtggagatcaaaacgaactgtggctgcaccatctgtcttcatccttccgcatctgatacgtcgtatctgagcggctggcaaggctcagtagnnnnnnn

SEQ ID NO: 107541 - DNA, 287 bp, Homo sapiens
  misc_feature: GYAE6OF01AQQXU.12.1.A01.1.454.CMB.1.raw
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcgcatagnnnnnnn

SEQ ID NO: 107542 - DNA, 631 bp, Homo sapiens
  misc_feature: GYAE6OF01BNTFR.12.1.A01.1.454.CMB.1.raw
  modified_base (209)..(209): a, c, t, g, unknown or other
  misc_feature (209)..(209): n is a, c, g, or t
  modified_base (416)..(416): a, c, t, g, unknown or other
  misc_feature (416)..(416): n is a, c, g, or t
  modified_base (624)..(624): a, c, t, g, unknown or other
  misc_feature (624)..(624): n is a, c, g, or t
tcagatacgacgtacacgaccggtgctcgatttagacgtctcatcaaggaagggaagggggcaggagtcagtctcagtcaggtcacagcatggacatgagggtccccgctcagcctccgtggggctcctgctactctggctccgaggtgccagatgtgacatccagctcgacccagtcctccatccctccctgtctgcatctgtagganacaagtcaccatcacgttggccgggactaaacggagtagttattcgaccctaacgttaattttaaaagttggtaatacaaaacaaaaagcaaggacaaaacgtcccaaaagtcctacctagtatttatcgctgacccaccagtctgacgtaagggtcggttacccgagtaaggttcacgtcggcgtggatcgagggacagtattacnctacacatcgtagtacgtctacgagtcctagaagtattagttagtactttaacgtttacttacgtgtacagtacgtagtacgttacccgcgtacccttaccctattaccgtaccgtttaccggaaccgtaacgggaccctaaccggaccgtcgtaaggtacgttacgggaacctaacggttggtaccggacctaggaccctaaccgtnttacccg

SEQ ID NO: 107543 - DNA, 569 bp, Homo sapiens
  misc_feature: GYAE6OF01DRCNI.12.1.A01.1.454.CMB.1.raw
tcagatacgacgtacacgaccggtgctcgatttagacgtctcatcaggggagtctcagtcaggacacagcatggacatggagggtccccgctcagctcctggggctcctgctactctggctccgaggtgccagtatgtgacatccagatgacccagtctccatcctcctgtctgcatctgtagcagacagagtcaccatcacttgccggcaagtcagaccatcagcagctatttaaatgtatcagcagaaccaggaacgccctaaggtcctgatctatcgctgcatcctagtttgactaaaggtcgggtacccagtcgtaaaggtttccaaggtggtacgaggttggggtcctaggggactagtactttcactctacacctatcagctagtctagaccaacgtggaactattctagtaccttaactttacttacttacgttacaaacgtagtaacgtaaccttaccgtttacccctccttaacgtttcgggaacggtaccggaaccgtaagggtaggaacgtaacttacgaaacgtacgtggtacgctagaccacctatcgtgttaccc

SEQ ID NO: 107544 - DNA, 631 bp, Homo sapiens
  misc_feature: GYAE6OF01CBBYQ.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatcacttggccgggcaagtcagaccatcagcagctatttaaatggtatcagcaagaaacagggaaacgccccgtaaggtccagatctatgctgcatccagtttcgacgtaaaggtcggggtaccctagtacgtaaaggttcaaggtcggcaagggttgggtacgttaggggactaagtactttccaacttcctcacctatcaaggtcaaggttctacggacctaaaccgtgtaaacgattttcgacgtacttaacttaattacttacgactaaacgagtaacgtaaacctaccgttacccttacctacggtttcgggaccgggtaagggtaacccaaggggttaggaaacgtacgtaaacgaaaaccggtaaacgttcgggtagggtacccgttacgggaccccaaccgttaacgtccggtttaagtttacccg

SEQ ID NO: 107545 - DNA, 622 bp, Homo sapiens
  misc_feature: GYAE6OF01B1MK3.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctaatttaaattggtatcagacaagaaaccgagggaaacgccccgtaaggtcctgactctatgctgctactcctagtttcgacgtaaaggtcggggtacccagtacgtaagtttcgaggtcggcgtaggttcgggtcgtagggaactaggtactttactacgttcctaccaacctactacgacgtactacggttctacgacctaaaccgtaggtaaactacgtttaccgtacgtaacttaactttaacttacgttacgtaacctaaacgtagtaaacttaaccgtactttaaccccgtcccgttaacgttccgggacgggtaacgggacccgtaagggtacggacgtaactaacggaaacgtacgtcggtagtcgtcgctaaccg

SEQ ID NO: 107546 - DNA, 630 bp, Homo sapiens
  misc_feature: GYAE6OF01CYEON.12.1.A01.1.454.CMB.1.raw
tcagatacgacgtacacgaccggtgctcgatttagacgtctcatcagggggagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatcacttgccgggcaagtcagaccatcagcagctatttaaatggtatcagcaagaaaccagggaacgcccctaaaggtcctgatctatgctgctatccagtttgactaaaggtcgggtacccatcgaaaggttcaggtggcgtaggtgggtcgtggggactagtactttcactctacacatcagacagtctacgacctaaaccgtgtaactactttctacgaccttaaactttacttaactcgttaacaaacgtaaggtaacgttaaacccgtaccgtttaacccccttccccgttaacggtttccggggaaccgggtaacggggtaacccgtaaagggggtaggtaaccggtaaacgtaaccgaaaaaccgggtacgttagggtaccggtaccgttacggaccctaacccgtagttccgtttcgttacccg

SEQ ID NO: 107547 - DNA, 289 bp, Homo sapiens
  misc_feature: GYAE6OF01A7MN8.12.1.A01.1.454.CMB.1.raw
  modified_base (276)..(276): a, c, t, g, unknown or other
  misc_feature (276)..(276): n is a, c, g, or t
  modified_base (282)..(289): a, c, t, g, unknown or other
  misc_feature (282)..(289): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaagggcncatagnnnnnnnn

SEQ ID NO: 107548 - DNA, 297 bp, Homo sapiens
  misc_feature: GYAE6OF01CVYYJ.12.1.A01.1.454.CMB.1.raw
  modified_base (291)..(297): a, c, t, g, unknown or other
  misc_feature (291)..(297): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaaacagagtaacacgttacccctcctacgtttcggcggaggaccaaggtggagatacaaacgactgtaggctgcacatctgtctcatcctccgcctatctagactacgtcgtatctggagcgggctggcaacggcgtcaatagnnnnnnn

SEQ ID NO: 107549 - DNA, 345 bp, Homo sapiens
  misc_feature: GYAE6OF01D9ZCO.12.1.A01.1.454.CMB.1.raw
  modified_base (134)..(134): a, c, t, g, unknown or other
  misc_feature (134)..(134): n is a, c, g, or t
  modified_base (168)..(168): a, c, t, g, unknown or other
  misc_feature (168)..(168): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (304)..(305): a, c, t, g, unknown or other
  misc_feature (304)..(305): n is a, c, g, or t
  modified_base (307)..(307): a, c, t, g, unknown or other
  misc_feature (307)..(307): n is a, c, g, or t
  modified_base (310)..(345): a, c, t, g, unknown or other
  misc_feature (310)..(345): n is a, c, g, or t
tcagatacgacgtacacgaccggtgctcgatttagacgtctcatcagggagtagaacgttattcagccaggcacgacaacagagggcagttcctagatttcactctcaccatcagcagtctgccaacctgaagnttctgctaacttattacgtgtcgacagagtaacngttaccctcccactttcggcggagggaccaagggtggagatacgaaacggaactggtggctgcaccagtctgtcttcgatcctcccgctatctgattacgtcgtatctgagcgggntgggcaaggcnctagtagcnngnagnnnnnnnnnnnnnnnnnnnnnnnnnnnnnnnnnnnn

SEQ ID NO: 107550 - DNA, 624 bp, Homo sapiens
  misc_feature: GYAE6OF01BUF5B.12.1.A01.1.454.CMB.1.raw
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcaagaaccagggaaacgccctaaggtcctgatctatgctgcactctagtttgacgtaaggtcggtacctatacgtaaggttcgaggtcggcgtaggttcgggtcgtaggggactagttcttaccgtactctaccacctagtcaacgtctagtctcgacctaacgtagtaactattcacgtaaccttaaactttacgttaacgtcgtaaccaacgtaagtaaccgtaacgttacccgttaccccgtccctaaccgggtttcgggaaccgggtaaccgggtaaccggtacgggtaggtaacgtaaccgtaacgaaaccgtagtcggtacggtaccgtcgaacctacgtacttcgttacttaccgttacctaactttcccctcccggtacttaccg

SEQ ID NO: 107551 - DNA, 291 bp, Homo sapiens
  misc_feature: GYAE6OF01ECVFS.12.1.A01.1.454.CMB.1.raw
  modified_base (283)..(291): a, c, t, g, unknown or other
  misc_feature (283)..(291): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatacaaacgactgtggctgcaccatctgtcttcatccttcccgcatctgatacgtcgtatctgagcgggctggcaaggcgctatagnnnnnnnnn

SEQ ID NO: 107552 - DNA, 282 bp, Homo sapiens
  misc_feature: GYAE6OF01AW96D.12.1.A01.1.454.CMB.1.raw
  modified_base (280)..(282): a, c, t, g, unknown or other
  misc_feature (280)..(282): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttccgcatctgatacgtcgtatctgagcgggctggcaaggcgcatagnnn

SEQ ID NO: 107553 - DNA, 667 bp, Homo sapiens
  misc_feature: GYAE6OF01CI51Y.12.1.A01.1.454.CMB.1.raw
  modified_base (191)..(191): a, c, t, g, unknown or other
  misc_feature (191)..(191): n is a, c, g, or t
  modified_base (621)..(621): a, c, t, g, unknown or other
  misc_feature (621)..(621): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtancagacagagtcaccatcacttcgccgggacaagtcagaccatcagcagacttaatttaaatggtatcagacaaggaaaccaagggaaacaccccgtaaggtcctagactctatcgtctgacacttacctaggtttgaacgtaaacggttcggggtacccctagtacgtaagggtttaccaaggttcggacgtagggttcggggttacgtacggggtaactacggttactttaccgaaccgtttcctaaccgaacccctagttacccgaagtacccgtaacggttccttaaccggaaccttaaacccgtagaaacgttacttacgtacgaacttaactttacttacgtacgtaactaacgacgtaaacttaccgtaccttacccctaccgttaccggttaccgggacgggtaacgggtaaccaaggggtanaacgaaccgtaacgaaacgtcgttaggacgtactcggaacctaccg

SEQ ID NO: 107554 - DNA, 291 bp, Homo sapiens
  misc_feature: GYAE6OF01DCCVG.12.1.A01.1.454.CMB.1.raw
  modified_base (244)..(244): a, c, t, g, unknown or other
  misc_feature (244)..(244): n is a, c, g, or t
  modified_base (284)..(291): a, c, t, g, unknown or other
  misc_feature (284)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatccttcccgcatcngatacgtcgtatctgaggcggctggacaaggcgcagtagnnnnnnnn

SEQ ID NO: 107555 - DNA, 624 bp, Homo sapiens
  misc_feature: GYAE6OF01CSWE4.12.1.A01.1.454.CMB.1.raw
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (458)..(458): a, c, t, g, unknown or other
  misc_feature (458)..(458): n is a, c, g, or t
tcagatacgacgtacacgaccggtgctcgatttagacgtctcatcaagggaagggaagggggcaggagtcagtctcagtcaggtcacagcatggacatgacgggtccccgctcagctccgtggggctcctgctactctggctccggaggtgccagatgtgacatccagctgacccagtcctccatccctcctgtcctgcatctggaggagacaaagtccaacatcacgttcggccgggactaacgngtagtatcgaccctaagttatttaaagttgtaatacaaaanaaaagcaaggacaaaagtcccaaagctactagtattatgctcgacccactagtccngacgtaagggttcggttccccgtagtaaggttcacgtggcccgtaggactacggagggactaacgtactttacgctacacctatacgagttacgtactacgacgtctagaaactntagttgtaacttattacgttactggtacagtaccgtaagtaccgttaccggcctaccttcccagttccccttagttacccggacgaaccggaccgtaacgacccggataggtaacgttccgggaacgtaacgtttcggacgttaccgacacccgtatgttacccgg

SEQ ID NO: 107556 - DNA, 652 bp, Homo sapiens
  misc_feature: GYAE6OF01COV0F.12.1.A01.1.454.CMB.1.raw
tcagatacgacgtacacgaccggtgctcgatttagacgtctcatcagggggagtctcagtcaggacacagcatggacatgagggtccccgctcagctcctggggctcctgctactctggctccgaggtgccagatgtgacatccagatgacccagtctccatccctccctgtctgcatctgtagcagacagatcaccatcacttgccgggcaagtcagaccatcagcagtcttaattttaaattggtaatcagacaagaaaccgagggaaacgcccctaaggtcctagatctatgctgcatcctagtttacgacgtaaaacgggtcggggtaccctaagttaccgtaaagggtttccgagggttcgggacgtaagggttcggggtccgttagggggaacgtaagttacttttccgacttcctcaacctactcgagctagtcctagacctaaacgtagaagtactttcgtacgaccttaacttttattacgttagtactaaacgtaggtaacgtttaaacctaccggtttaacccccttcccgttaacgttttccgggacgttagggaaccgggtaacgtagggtaggaaagtacgtaacgaaaccggtaacgttgggtccgtacgttacgactaaccctgttcgtttaccgg

SEQ ID NO: 107557 - DNA, 287 bp, Homo sapiens
  misc_feature: GYAE6OF01BN3FK.12.1.A01.1.454.CMB.1.raw
  modified_base (281)..(287): a, c, t, g, unknown or other
  misc_feature (281)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaggcgcatagnnnnnnn

SEQ ID NO: 107558 - DNA, 285 bp, Homo sapiens
  misc_feature: GYAE6OF01BVLTA.12.1.A01.1.454.CMB.1.raw
  modified_base (281)..(285): a, c, t, g, unknown or other
  misc_feature (281)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgactgtggctgcaccatctgtcttcatcttcccgccatctgatacgtcgtatctgagcgggctggcaaggcgcatagnnnnn

SEQ ID NO: 107559 - DNA, 493 bp, Homo sapiens
  misc_feature: GYAE6OF01E4SB2.12.1.A01.1.454.CMB.1.raw
  modified_base (354)..(354): a, c, t, g, unknown or other
  misc_feature (354)..(354): n is a, c, g, or t
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtcngcaacctgaagattctgctaacttattactgtacaacagagtaactacgttaccctcccacgtttcggacggtagggaccaagggtggagatcgaaacgactgtggctgcaccatctcgtcttcatccttcccgcgtac

SEQ ID NO: 107560 - DNA, 284 bp, Homo sapiens
  misc_feature: GYAE6OF01DRU8J.12.1.A01.1.454.CMB.1.raw
  modified_base (279)..(284): a, c, t, g, unknown or other
  misc_feature (279)..(284): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggaggaccaaggtggagatcaaacgactgtggctgcacatctgtcttcatcttcccgctatctgatacgtcgtatctgaggcggctggcaaggcgcatagnnnnnn

SEQ ID NO: 107561 - DNA, 664 bp, Homo sapiens
  misc_feature: GYAE6OF01C82RO.12.1.A01.1.454.CMB.1.raw
  modified_base (91)..(91): a, c, t, g, unknown or other
  misc_feature (91)..(91): n is a, c, g, or t
  modified_base (214)..(214): a, c, t, g, unknown or other
  misc_feature (214)..(214): n is a, c, g, or t
  modified_base (276)..(276): a, c, t, g, unknown or other
  misc_feature (276)..(276): n is a, c, g, or t
tcagatacgacgtacacgaccggtgctcgatttagacgtctcatcaggggagtctcagtcaggacacagcatggacagtgagggtccccgntcagctcctggggctcctgctactctggctccgaggtgccagatggtcgacatccagatcgacccagtctccatcctcctgtctgcatctgtagcagacagactcaccatcacttggccgganaagtcaagaccatcagcagtctaattttaaatggtaatcgagacaacgaaacgagggaaacnccccgtaagtcctagtactctatgctgtactacttccgtagtttcgacggtaaaggtcgggtaccctaatccgtaaaggttcgaagtcggcgtaggtcgggtcgtaggggtaactaggttacctttcgaaccttcgtactaacccgtatccgaagtactacggtctacggaacctaaccgtagtaagtactttcgtacgtaacttaacttttacgttaacctacgttaacgaaacgtaagtaacgttaacccgttaccgttaccccttacccgttaacggtttccggaaccgggtaacggaccggtaaaggttacggaaacgtacgtaaacgaaaaccgttacggtaggacggtactaccgtacctacctacgtccgttcgttaaccg

SEQ ID NO: 107562 - DNA, 285 bp, Homo sapiens
  misc_feature: GYAE6OF01CNKU8.12.1.A01.1.454.CMB.1.raw
  modified_base (279)..(285): a, c, t, g, unknown or other
  misc_feature (279)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctccactttcggcggagggaccaaggtggagatcaaacgaactgtggctgcacatctgtctcatcttcccgcatctgatacgtcgtatctgagcgggctggcaaggcgcatagnnnnnnn

SEQ ID NO: 107563 - DNA, 286 bp, Homo sapiens
  misc_feature: GYAE6OF01AM53Z.12.1.A01.1.454.CMB.1.raw
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtctcatcttcccgcatctgatacgtcgtatctgagcgggctggcaaggcgcatagnnnnnn

SEQ ID NO: 107564 - DNA, 842 bp, Homo sapiens
  misc_feature: GYAE6OF01DLZ80.12.1.A01.1.454.CMB.1.raw
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgagcagacagagtcaccatcacttgccgggcaagtcagaccatcagcagcttaatttaaattggtatcagacaagaaacaagggaacgaccctaaggtcctgatctatcgcttgacactaccgtagtttacgacgtaaaggttccgggggtacccctaagtaccgtaaaaccggggttttcgaaagggtttacggggcccgtaacggggttggggggttaccggttaacggggggtaactaacgggtttaactttttcccgtaaacccgtttcccgtttaacccgaacccccgttaaattaccccgaacggtacccgttaaacggttcccgttacgggaacccttaaaaccccgtaggggtaaacctttaacctttttccgggaaccgtttaacccttaaaccggtttttaaacttttacccgttaacgggtttaaacccgaaacttaaaccgggttaaacgggttaaacccttttaaccccgggttaaccccccttacccctttaccgggttttacccgggggaaccggggttaaaccggggggaaaacccctaaagggggttaccggggtaaacgtaaaccgtttaaaccgggaaaaacccggttaaacggttcggggttacggttaacccgtccgggtcccttaaaacccgg

SEQ ID NO: 107565 - DNA, 289 bp, Homo sapiens
  misc_feature: GYAE6OF01D6MEN.12.1.A01.1.454.CMB.1.raw
  modified_base (282)..(289): a, c, t, g, unknown or other
  misc_feature (282)..(289): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatccttcccgcatctgatacgtcgtatctgagcggctggcaaggcgcatagnnnnnnnn

SEQ ID NO: 107566 - DNA, 630 bp, Homo sapiens
  misc_feature: GYAE6OF01DITNS.12.1.A01.1.454.CMB.1.raw
  modified_base (211)..(211): a, c, t, g, unknown or other
  misc_feature (211)..(211): n is a, c, g, or t
  modified_base (274)..(274): a, c, t, g, unknown or other
  misc_feature (274)..(274): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagatcaccatcacttggccgganaagtcagaccatcagcagtcttaatttaaagttggtatcaagacaaggaaaccgagggaaacnccccgtaaggtcctagactctatcgctgcactccgtagttgacgtaaggtcgggtaccagtcgtaaggttcaggtcggcgtaggtcgggtcgtggggactaggtactttcaccgtctacacctatacagtcgacgtctcgacctaaacgtgtaacgtactttcgtacgtacgttaactttaattacgtacgttaaccaaacgtaacggttaaccgttaaaccttacccgtttaacccccttacccgttaaccgggtttaccggggaaccgggtaaccgggtaaccgaagggtacggaacgtaacgtaacgaaacggtacgttggtcggtactcgacctaccgtctcgttcgttacc

SEQ ID NO: 107567 - DNA, 290 bp, Homo sapiens
  misc_feature: GYAE6OF01AL1GH.12.1.A01.1.454.CMB.1.raw
  modified_base (275)..(275): a, c, t, g, unknown or other
  misc_feature (275)..(275): n is a, c, g, or t
  modified_base (281)..(290): a, c, t, g, unknown or other
  misc_feature (281)..(290): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcncatagnnnnnnnnnn

SEQ ID NO: 107568 - DNA, 589 bp, Homo sapiens
  misc_feature: GYAE6OF01A4SFG.12.1.A01.1.454.CMB.1.raw
  modified_base (211)..(211): a, c, t, g, unknown or other
  misc_feature (211)..(211): n is a, c, g, or t
tcagatacgacgtacacgaccggtgctcgatttagacgtctcatcagggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagctatttaaattggtatcagcaagaaaccagggaaacgcccctaaggtcctagatctatgctgcatccagtttgacaaagtcgggtacccatcgaaggttcaggtggcgaggtgggtcgtagggactagtattcactctcaccatcagcagtctcgactaacctgaagtacttctacgtactaactttacttactacgtacaaacgtaagtaacgtaacctaccgtttaaccccttacccgtaaccgttttccggggacgggtaacgggacccgtaaagggtacggaacgtaacgttaaccgaaaacggtaccgttaggtacggtacgtacggaccctaaccacgtttccgtcgttacccg

SEQ ID NO: 107569 - DNA, 285 bp, Homo sapiens
  misc_feature: GYAE6OF01A24XZ.12.1.A01.1.454.CMB.1.raw
  modified_base (275)..(275): a, c, t, g, unknown or other
  misc_feature (275)..(275): n is a, c, g, or t
  modified_base (281)..(285): a, c, t, g, unknown or other
  misc_feature (281)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggctggcaaggcncatagnnnnn

SEQ ID NO: 107570 - DNA, 654 bp, Homo sapiens
  misc_feature: GYAE6OF01B5LKM.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaaattgtatcagcagaaaccagggaaacgccccgtaaggtcctgatctatgctgcactcctagtttgacgtaaaggttcggggtaccctaagtactaaagggtttcaacggttcgggtacgagggttcggggtacgtacgggggaactaaggtaacttttaccgaaccttcctaccctaaccctatacccgtaacggtcctaaggttcctacggtacctaaacccgttaggaacgttactttccgtacggtacctaaacttttacgttaaccttggttaacaaacgtaagtaacgttaaccttaacggtttacccccttacccgttaccggtttccgggacggtaagggaacctaagggtacggaggtactaacggaaacgtacgtggtacggccttacggacaacctacgtcgtgttacc

SEQ ID NO: 107571 - DNA, 551 bp, Homo sapiens
  misc_feature: GYAE6OF01AR6BP.12.1.A01.1.454.CMB.1.raw
  modified_base (352)..(352): a, c, t, g, unknown or other
  misc_feature (352)..(352): n is a, c, g, or t
tcagatacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagcttatttaaatggtatcagcaagaaaccagggaaacgcccctaaggtcctgatctatgctgcatcctagtttgacgtaaaggtcggggtcccatcgaaggttcagtggctaggtgggtcgtgggacagtatttcactcncacatcagcagtctgaccaactgaagtcttctacgtactaaacttagttactacgtacaacagtaacgttaactacgtttaacccctccgtacgtttaccgggacgggtacgggaaccgtaagggtacggagaactacgaaacggtaactagggtacgcgtgacacctatcgtgttccttacacttccctcccgctacg

SEQ ID NO: 107572 - DNA, 615 bp, Homo sapiens
  misc_feature: GYAE6OF01CJ436.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagagtcaccatcacttgccgggcaagtcagaccatcagcagctaatttaaagtggtatcagacaagaaaccagggaaacgccccgtaaggtcctagatctatgctgcatcctagtttgacgtaaaggtcggggtacctagtacgtaaggttcgaggtggacgtaggttgggtcgtaggggactaggtactttacgactcctaccaaccgtatcgaagctaagtctacgactaaaccgtgaacgtacttacgtacgaaccttaactttacttaactagtaccaaacgtaagtaacgttaaaccgtaccgtttaacccccttaccgttaccggtttccgggaaccgggaaccgggtaaccgaagggtacggaagtaacgtaacgaaacgtacgtggtacggactacgaccacctactcgttcgttaccg

SEQ ID NO: 107573 - DNA, 720 bp, Homo sapiens
  misc_feature: GYAE6OF01D19XB.12.1.A01.1.454.CMB.1.raw
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
tcagatacgacgtacacgaccggtgctcgatttagacgtctcatcagggggcaggagtcagtctcagtcaggacacagcatggacatgacgggtccccgctcagctccgtggggctcctgctactctggctccgaggtgccagatgtgacatccagatcgacccagtctccatcctcctgtctgcatctgtancagacagntcacatcacttgccgganaagtcagaccatcagcagcttaatttaatggtatacagacaaggaaaccgaagggaaacgtaccccgtaaggtaccctagtactacttaacgtcgtccttacgactaacttaccgttaagttacggtaacgtaaaacgggttccgggggtaacccctaaaggttaaccgtaaacgggtttaccgtacgggttacgggtaccgtaacggggttcggggttacgtacgggggtaaacctaaggtcccctttaacgggaactttccgaaccgtaactactacggactacggacttcgacgaaccctagtacgaaacgttctacgagtaaccttaacgtttctaacgtacgtaacctaaacgtgttaaaccgtaacgttaacccgtttaccccacctttaaccggttcccgggaaaggggtttaacccggaacggttaaggggtccaaaggtttcccgaaaacggaaaccgtcttacggggaccttcggtacacccgtaaaccgg

SEQ ID NO: 107574 - DNA, 298 bp, Homo sapiens
  misc_feature: GYAE6OF01CZ34H.12.1.A01.1.454.CMB.1.raw
  modified_base (276)..(276): a, c, t, g, unknown or other
  misc_feature (276)..(276): n is a, c, g, or t
  modified_base (283)..(298): a, c, t, g, unknown or other
  misc_feature (283)..(298): n is a, c, g, or t
tcagatacgacgtacacgaccggtgctcgatttagacgtctcatcagggatagaagttattcagcaggcacacaacagaggcagttccagatttcactctcaccatcagcagtctgcaactgaagattctgcaacttattactgtacaacagagtaacagttaccctcccactttcggcggaggaccaaggtggagatacaaacgactgtggctgcaccatctgtctcatcctccgcatctgatcgttcgtatctagagcgggctggaccaaggcncatacgnnnnnnnnnnnnnnnn

SEQ ID NO: 107575 - DNA, 296 bp, Homo sapiens
  misc_feature: GYAE6OF01EOMN7.12.1.A01.1.454.CMB.1.raw
  modified_base (289)..(296): a, c, t, g, unknown or other
  misc_feature (289)..(296): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacacgtttaccctccctactttcggcggagggaccaagggtggagactacaaacgaactgtggctgcaccatctgtcttcatccttcccgcctatctgatacgtcgtatctgaggcggctggcaggcgcatgnnnnnnnn

SEQ ID NO: 107576 - DNA, 288 bp, Homo sapiens
  misc_feature: GYAE6OF01CJGCQ.12.1.A01.1.454.CMB.1.raw
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcacatctgtcttcatcttcccgcatctgatacgtcgtatctgagcgggctggacaaggcgcatagnnnnnnnn

SEQ ID NO: 107577 - DNA, 743 bp, Homo sapiens
  misc_feature: GYAE6OF01D665K.12.1.A01.1.454.CMB.1.raw
tcagatacgacgtacacgaccggtgctcgatttagacgtctcatcagggggcaggagtcagtctcagtcaggacacagcatggacatgacgggtccccgctcagctccgtggggcctcctgctactctggctccgaggtgccagatgtgacatccagatcgacccagtcctccatccctcctgtctgcatctgtagcagacagactcacatcacgtcggccggacaagtacacgaccatcagcagttaactttaaagtttaaagtggtaactacgaacgaccgaaacgggaaaacccggaaaggggaaaccccgtaccccggttaaaacggtccgtaagtaacgttacctagtcgtcctgactacttaccgtagttacgaacggtaacggtccgggtaacctagtacgtaacggttcgtacggtgacggtaggtggggtacgtacgggtactaacggttctacgtaccttccgactaaccgtagtaccgtacgtacgtcgtacgacgtaaccgtaaccgtaggtaactcttacgaacgtaactttaaaccgtttagttaaccgtaacgtaacttaaacggtaacttaacccgttaacttacccccggttaccccctaaccgggttaccggttacccggggaacgggtaaaccgggtaaaccggtaagggtaacgtaaacgtaacccggtaaaacccgtaaacggtacggttacggtaccggtactaacccggaccttaaaccg

SEQ ID NO: 107578 - DNA, 328 bp, Homo sapiens
  misc_feature: GYAE6OF01CQ2EF.12.1.A01.1.454.CMB.1.raw
  modified_base (306)..(328): a, c, t, g, unknown or other
  misc_feature (306)..(328): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaaacagaagtaacacgttacccctcccgactttcgggaccggaagggaccaaggtggagactacaaacgaacgtgtggctgcacatctgtcttcactctcccgactatctgtaatcgtcgtactctgacggtcggactggacgaaggcgacaagtaggnnnnnnnnnnnnnnnnnnnnnnn

SEQ ID NO: 107579 - DNA, 291 bp, Homo sapiens
  misc_feature: GYAE6OF01A6PRE.12.1.A01.1.454.CMB.1.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (284)..(291): a, c, t, g, unknown or other
  misc_feature (284)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttacccctccctactttcggcggagggaccaaggtggagatcaaacgactgtggctgcacatctgtctcattcctccgctatcngtatacgtctatctggngcgggctggcagggccacagtgnnnnnnnn

SEQ ID NO: 107580 - DNA, 319 bp, Homo sapiens
  misc_feature: GYAE6OF01A9Z1Y.12.1.A01.1.454.CMB.1.raw
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (289)..(290): a, c, t, g, unknown or other
  misc_feature (289)..(290): n is a, c, g, or t
  modified_base (292)..(319): a, c, t, g, unknown or other
  misc_feature (292)..(319): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccatcngatacgtcgtatctgagcgggctggcaaggcgccgataggcngnncnnnnnnnnnnnnnnnnnnnnnnnnnnnn

SEQ ID NO: 107581 - DNA, 705 bp, Homo sapiens
  misc_feature: GYAE6OF01BH3T4.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctccctgtctgcatctgtagcagacagagtcacatcacttgccgggacaagtcagaccatcagcagcttaatttaatgtatcagcaagaaacgagggaaacgccccgtaaggtcctagacttcgtatcgactgacctattccgtaaggtttacggaacgtaaaacggttccggggtaccccaagttaacgtaaggtttcgaagggttggaccgtaagggttcggggtacgtacgggggtaactaaggttacttttacgtaccttccttacccaacctacgttacgacgtaccgtacgttccgttacgaaccgtaaaccgtaggtaaacgttatttccgtaacgtacttaaacgttttaacttacgtaagttaaccgaaagtaacgtaacgtaaccttaccgttaaccccgtaccgttaccggtttacgggaacgggtaacgggtaaacgtacgggtacggtaaacgtcgttaaaccgaaaacggtaacgttacgggtaggtaccgttacgacccgaaaccttagtccggttcggtttaaccc

SEQ ID NO: 107582 - DNA, 285 bp, Homo sapiens
  misc_feature: GYAE6OF01EL94P.12.1.A01.1.454.CMB.1.raw
  modified_base (280)..(285): a, c, t, g, unknown or other
  misc_feature (280)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcacatctgtcttcatcttcccgcatctgatacgtcgtatctgagcgggctggacaaggcgcatagnnnnnn

SEQ ID NO: 107583 - DNA, 317 bp, Homo sapiens
  misc_feature: GYAE6OF01DGIU4.12.1.A01.1.454.CMB.1.raw
  modified_base (128)..(128): a, c, t, g, unknown or other
  misc_feature (128)..(128): n is a, c, g, or t
  modified_base (192)..(192): a, c, t, g, unknown or other
  misc_feature (192)..(192): n is a, c, g, or t
  modified_base (299)..(317): a, c, t, g, unknown or other
  misc_feature (299)..(317): n is a, c, g, or t
tcagatacgacgtacacgaccggtgctcgatttagacgtctcatcagggatagaagttattcagcaggcacacaacagaggcagttccagatttcaactgctcatcagcagtctgcaactgagattcngcaacttattactgtcaacagagtaaacacgttaccctccactttcggcggaaggacctaaggnggacgatacaaaacgacttgcggctgacacctaatctgttctcatctccgcatctagactacgtcgtatcgtagaggcggcgtaggacgaacgggtcactaagtgannnnnnnnnnnnnnnnnnn

SEQ ID NO: 107584 - DNA, 568 bp, Homo sapiens
  misc_feature: GYAE6OF01DEOHN.12.1.A01.1.454.CMB.1.raw
  modified_base (365)..(365): a, c, t, g, unknown or other
  misc_feature (365)..(365): n is a, c, g, or t
  modified_base (429)..(429): a, c, t, g, unknown or other
  misc_feature (429)..(429): n is a, c, g, or t
  modified_base (456)..(456): a, c, t, g, unknown or other
  misc_feature (456)..(456): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
tcagatacgacgtacacgaccggtgctcgatttagacgtctcatcaggggagtctcagtcaggacacagcatggacatgacgggtccccgctcagctcctggggctcctgctactctggctccgaggtgccagatgtgacatccagatgacccagtcctccatccctccctgtcctgcatctgtagcagacagagtccaccatccacgtttggcccggggacaagtcaagtaccatcagcagcttatttaatggtatcagcaagaaaccgaggaacgccctaaggtcctagatcgatgctgctactctagtttgacgtaaaggtcgggtacccataccgaaggttcaggtggactaggtcgggtntggggataggtactttcacgtctacacctatcagctagtctcgactaaccgtagaacgtattcncgtactaacgtttattactgtacaaanagtactactaccgttaccctcgtaccgtttcgggacggtaacggacgtagggtaggacgtacgtaacgaaacggtntacggnggtactacgactaacctgttcctcgttacc

SEQ ID NO: 107585 - DNA, 598 bp, Homo sapiens
  misc_feature: GYAE6OF01CR9PB.12.1.A01.1.454.CMB.1.raw
tcagatacgacgtacacgaccggtgctcgatttagacgtctcatcagggggcaggagtcagtctcagtcaggacacagcatggacatgagggtcccagctcagctcctggggctcctgctactctggctccgaggtgccagatgtgacatccagatgacccagtctccatccctccctgtctgcatctgtagcagacagagtcaccatcacttcgccgggcaagtcagaccatcagcagtacttaatttaaattggtatcagacaaggaaaccgagggaaacgcccctaaggtcctgatctatgctgcatcctagtttacgacgtaaacggtcggggtacccagttacgtaaggtttcgaggtgggccgtagggttcggggtcgttgggactaggttactttccaccttcctaccacctacttccgagtacctaggttccacggtaccaaaccgttaggaaagttacttcgttacccgtaacttaacgtttacttacgttcgtacaacgtacgtaacgtaacctacgttacccctccgtacgtttcgggacggacgggacgaaggtggataacgacaaacgtacgtgtcggctcgtac

SEQ ID NO: 107586 - DNA, 664 bp, Homo sapiens
  misc_feature: GYAE6OF01CXHPF.12.1.A01.1.454.CMB.1.raw
  modified_base (127)..(127): a, c, t, g, unknown or other
  misc_feature (127)..(127): n is a, c, g, or t
  modified_base (299)..(299): a, c, t, g, unknown or other
  misc_feature (299)..(299): n is a, c, g, or t
  modified_base (439)..(439): a, c, t, g, unknown or other
  misc_feature (439)..(439): n is a, c, g, or t
  modified_base (650)..(650): a, c, t, g, unknown or other
  misc_feature (650)..(650): n is a, c, g, or t
tcagatacgacgtacacgaccggtgctcgatttagacgtctcatcaggggagtctcagtcaggacacagcatggacatgagggtccccgctcagctcctggggctcctgctactctggctcgaggtnccagatgtgacatccagatcgacccagtcctccatccctccctgtcctgcatctgtagcagacagtagtcaccatcctaacgttcggacccgggacaaaggtccaagacccaatccaggcagtacttaatttaaagttggtaatcaagacaacgaaaaccgaacgggaaacnccccgtaaggtcctagtaactctatcactcgactactccgtagtttacgacgtaaagggtccgggtaccatacgtaaggttcgaggtggacgtaggtcgggtcgtagggactaggttactttcacttcctacaccgtacncgaagctaacggttctacgaactaaacccgtgaacgtactttcgtataccttaattttacgtacttacgaactaaacgtacgtaacgttaacccttacttacccccgttacctaaccggttttcgaacggttaggtaaaccggggactaaggggtacggaacgtaattaacccggaaagttacgtcggtacggtacctacgacctaaaccngtttaccgttaccg

SEQ ID NO: 107587 - DNA, 679 bp, Homo sapiens
  misc_feature: GYAE6OF01DAICN.12.1.A01.1.454.CMB.1.raw
  modified_base (188)..(188): a, c, t, g, unknown or other
  misc_feature (188)..(188): n is a, c, g, or t
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagatacgacgtacacgaccggtgctcgatttagacgtctcatcagggggcaggagtcagtctcagtcaggacacagcatggacatgaggtccccgctcagctcctggggctcctgctactctggctccgaggtgccagatgtgacatccagatgacccagtctcatcctcctgtctgcatctgtancagacaggtagtaccaacctatcctacgttcggacccgggnaaaggtccagaccatcagaccagtacttaattttaaattggtaactacgagactacggaaaaccgagggaaaccncccgtaaggtcctagaatctatcgctgcagtccgtagtttgactaaggtcggtacctagtctaaggttcaggtcgtacgtaggtggtacgtgggacaggttacttcacgtctacgactntacngtactacgttcacggtaacctaaccgttagaacgttaccttcgtaacgtaaccttaaacgtttaccgttacgttaaccgttaacgtaacgtaacgtaaccgtttaacgtacccgtttaaccccgtacccgtttaaccggttccgggaaccgggttaacggaacccgggttaaggttaccgggaaacgtaacccgttaaacggaaacccggttacggtttaacgaccggttactacgggtaccccttaaccgg

SEQ ID NO: 107588 - DNA, 168 bp, Homo sapiens
  misc_feature: GYAE6OF01BIWXR.12.1.A01.1.454.CMB.1.raw
  modified_base (168)..(168): a, c, t, g, unknown or other
  misc_feature (168)..(168): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctan

SEQ ID NO: 107589 - DNA, 286 bp, Homo sapiens
  misc_feature: GYAE6OF01C16OM.12.1.A01.1.454.CMB.1.raw
  modified_base (275)..(275): a, c, t, g, unknown or other
  misc_feature (275)..(275): n is a, c, g, or t
  modified_base (281)..(286): a, c, t, g, unknown or other
  misc_feature (281)..(286): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtctcatcttccgccatctgatacgtcgtatctgagcgggctggcaaggcncatagnnnnnn

SEQ ID NO: 107590 - DNA, 657 bp, Homo sapiens
  misc_feature: GYAE6OF01CU1G3.12.1.A01.1.454.CMB.1.raw
  modified_base (90)..(90): a, c, t, g, unknown or other
  misc_feature (90)..(90): n is a, c, g, or t
tcagatacgacgtacacgaccggtgctcgatttagacgtctcatcaggggagtctcagtcaggacacagcatggacatgagggtccccgntcagctcctggggctcctgctactctggctccgaggtgccagatgtgacatccagatcgacccagtctccatccctccctgtcctgctatcgtgtagcagacagtacgtccaccatcacttcggccggacaaggtcagaccatccagctagtcttaatttaaagtggtaatcaagacaacgaaaccgaagggaacctccccgtaaggtcctagactcgtatcgcttgactattaccgtaagtttagaacgtaacgggttcggtacctaagtcgtaaggttccagggtacggtacgtacggttcggggtaccgtacggggaactaagttactttctacccgtcttaccaacctagtcaacggtcacgttctacgactaaaccggtgtaactcttacgtacgtacttaactttacttactagtaccaaagtacgtaacgttaaccgtccgttaaccctaccgttacggttaccggacgggtaaccgggtacgtagggtacggtaacgtacgtaacggaaacgtacggtacgtggacctacggaaccctacgttacctgttccgttaccc

SEQ ID NO: 107591 - DNA, 291 bp, Homo sapiens
  misc_feature: GYAE6OF01A94JR.12.1.A01.1.454.CMB.1.raw
  modified_base (284)..(291): a, c, t, g, unknown or other
  misc_feature (284)..(291): n is a, c, g, or t
tcagatacgacgtacacgaccggtgctcgatttagacgtctcatcagggatagaagttattcagcaggcacacaacagaggcagttccagatttcaactgctcatcagcagtctgcaacttgaagattctgcaacttattactgtcaacagagtaacagttaccctcccatttcggcggagggaccaaggtggagatacaaaacgaactgtggctgcaccatctgtcttcatcttccgcatctgatacgtcgtatctgagcgggctggcaaggcgtacagtagnnnnnnnn

SEQ ID NO: 107592 - DNA, 694 bp, Homo sapiens
  misc_feature: GYAE6OF01BCSYB.12.1.A01.1.454.CMB.1.raw
  modified_base (220)..(220): a, c, t, g, unknown or other
  misc_feature (220)..(220): n is a, c, g, or t
tcagatacgacgtacacgaccggtgctcgatttagacgtctcatcagggggcgaggagtcagtctcagtcaggacacagcatcggacatgagggtccccgctcagctcctggggctcctgctactctggctccgaggtgccagatgtgacatccagatgacccagtctccatcctccctgtctgcatctgtagcagacagagtcaccatcacttgccggnaagtcagaccatcagcagctagtttaatggtatcagcagaacaggaacgccctaaggtcctgatctatgctgcatcctagttcgacgtaaaggttcggggtaccctagtacgtaagggttcaacggtcggtacgtaggtggggttacgtcggggaactaggtaacttttccgaacttccgtacctaacccctagttccaacggtccgtacggttaccttaggtaccctaaacccggttgtaaacgtactttaccgttagtaccctaaactttttacgttaaccgttacggttaacctaaccggtaacggttaacggttaaacccgtaccggtttaaccccccgttacccgtaaccggttttaccggggaccggggtaaaccggggtaacccgtaaaggggttcggggtaacgtaacgttaaccgaaaacccggtaacgtttacgggtacggtacccgttggacccttaacccgg

SEQ ID NO: 107593 - DNA, 732 bp, Homo sapiens
  misc_feature: GYAE6OF01DN5DL.12.1.A01.1.454.CMB.1.raw
  modified_base (245)..(245): a, c, t, g, unknown or other
  misc_feature (245)..(245): n is a, c, g, or t
tcagatacgacgtacacgaccggtgctcgatttagacgtctcatcagggggcagggagtcagtctcagtcaggacacagcatggacatggacgggtccccgctcagctccgtggggctcctgctactcgtggctccggaggtcgccgagagtgtagacactccagtatcgacccagtcctccactccctcctgtctcgctatcgtgagacacgacgagacgtaccacactctacgtcggccgganagtacacgacactacagactagtactttaaagtttaaggtgtaacgtacaacgaacgaaacggaaaacccggaacgggtaaacccgtacccggttaaacggtcctagtacttacgtagtcgtacgtacgactaccggttacgttacggttacggaacggtaacgggtccgggtaacctaacggttacggtacggtttacgaacgggtaggtcggttagggtcgggtacggtacggaactttacggttacttccgaccctacgtaacccgtacaccggttacgacggtacgtaccgtaccgtacgaaccttaaccgtaaggtacttcgtacgttaagttaacttaacgttttgaactccggtaaataaccggtagttaaccgttaccccgtacccgtaccggttaggtaccgggacggggtaaacggaaccggtagggtaagaacgtaacaccggtaaacgtccgtagggtcagtacccactcgttcg

SEQ ID NO: 107594 - DNA, 292 bp, Homo sapiens
  misc_feature: GYAE6OF01BP58U.12.1.A01.1.454.CMB.1.raw
  modified_base (284)..(292): a, c, t, g, unknown or other
  misc_feature (284)..(292): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtggagatcaaacgaactgtaggctgcaccatctgtcttcatcttcccgccatctgatacgtcgtatctgaggcggctggcaaggcgcagtagnnnnnnnnn

SEQ ID NO: 107595 - DNA, 752 bp, Homo sapiens
  misc_feature: GYAE6OF01ERK4T.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatccctcctgtctgcatctgtagcagacagagtcaccatcacttggccgggcaagtcagaccatcagcagtcttaatttaaagttgtatcagacaagaaaccgacgggaaacgaccccgtaaggtcctagattctagtgtctgctactacctagtttcgaacgtaaaggtcggggtaccctagtacgtaacggttcgaggttcggagtaggtcgggtcgtaggggactaggtactttcacttccgtaccacctactaccgagtacgtacgttcctagaacctaaacgtacggtaaacgttcttaccgtacgtaaccttaaacgttttactttaaccgtacgttaaccgtaaacgtaaacgttaaaccgttaaacccgttaacccggttttaacccccgttaccccggtttaaccgggttttacccggggaaccggggttaaaacccggggtaacccgggttaaaacggggtaccggggtaaaccgtaacgttaaaacccgggtaaaacggtaacccggttacggggttacccggtacccgtttaccggaaacccgttaacccgttaacgtttacccgttacggttttaacccc

SEQ ID NO: 107596 - DNA, 291 bp, Homo sapiens
  misc_feature: GYAE6OF01DCIJH.12.1.A01.1.454.CMB.1.raw
  modified_base (242)..(242): a, c, t, g, unknown or other
  misc_feature (242)..(242): n is a, c, g, or t
  modified_base (280)..(291): a, c, t, g, unknown or other
  misc_feature (280)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtctcatccttccgcatcngatcgtcgtatctgacgcggctggacaaggcgcatagnnnnnnnnnnnn

SEQ ID NO: 107597 - DNA, 729 bp, Homo sapiens
  misc_feature: GYAE6OF01CHKIU.12.1.A01.1.454.CMB.1.raw
  modified_base (341)..(341): a, c, t, g, unknown or other
  misc_feature (341)..(341): n is a, c, g, or t
tcagatacgacgtacacgaccggtgctcgatttagacgtctcatcaaggaagggaagggggcaggagtcagtctcagtcaggtcacagcatggacatgagggtccccgctcagctcctggggctcctgctactctggctccgaggtgccagatgtgacatccagctgacccagtctccactccctcctgtctgcatctgtaggagaacaagtcacatcacgttcgaccggactaacgagtacgtattcggacctaagttaatttaaagttggtaactacaaaaacgaaaagcgaacggaacctaaacggtacccaaaaggtccttaccgtagtattttacncgtcctacgaccacctaggtctacgacgtaacgggttcggtaccctagtacggtcctacggcggtcgtagacgtacggaagggtactaagttaaccttcgtactacgaacctagtacgtaacgttacgtacctaacgtacgtaccgtaaggaaacttacgttacttacggtactttaaacgtttacgttacgtagttacgaacgtcgtaacggttaccggtacccgtacgtaccccttaccgtaattaccccgttacgtttcccggaaccgtaaaccggggacccgtaaacccggtaccggtaccgtaaggtacggttaacccgggaaacgttaacccggttgggtacccggtacttaccggaacccctccgggttatttaccccggg

SEQ ID NO: 107598 - DNA, 524 bp, Homo sapiens
  misc_feature: GYAE6OF01A9F8E.12.1.A01.1.454.CMB.1.raw
  modified_base (300)..(300): a, c, t, g, unknown or other
  misc_feature (300)..(300): n is a, c, g, or t
  modified_base (504)..(504): a, c, t, g, unknown or other
  misc_feature (504)..(504): n is a, c, g, or t
  modified_base (517)..(517): a, c, t, g, unknown or other
  misc_feature (517)..(517): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaatggtatcagcagaaaccagggaaacgcccctaaggtcctgatctatgctgcatccagtttganaaaggtgggtacccatcgaagttcaggtggcgaggtgggtcgtaggggactaggtatttacactcgtcacctatcagcagtctacgacaaccgtgaacgtattctacgtactaactttattactagtacaagaagacgtaactaccgttaccctccgtacgttcggacggacgggacagggtagagtactacgaaacgtagtgnggctacgcacctntctgtcc

SEQ ID NO: 107599 - DNA, 282 bp, Homo sapiens
  misc_feature: GYAE6OF01AZM4L.12.1.A01.1.454.CMB.1.raw
  modified_base (279)..(282): a, c, t, g, unknown or other
  misc_feature (279)..(282): n is a, c, g, or t
tcagatacgacgtacacgaccggtgctcgatttagacgtctcatcagggatagaagttattcagcaggcacacaaaagaggcagttccagatttcaactgctcatcagcagtctgcaacctgaagattctgcaacttattactgtcaacagagtaacagttaccctccactttcggcggagggaccaaggtggagatcaaacgactgtggctgcaccatctgtcttcatcttcccgcatctgatacgtcgtatctgagcgggctggcaaggcgcatagnnnn

SEQ ID NO: 107600 - DNA, 288 bp, Homo sapiens
  misc_feature: GYAE6OF01EMPXO.12.1.A01.1.454.CMB.1.raw
  modified_base (275)..(275): a, c, t, g, unknown or other
  misc_feature (275)..(275): n is a, c, g, or t
  modified_base (281)..(288): a, c, t, g, unknown or other
  misc_feature (281)..(288): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcctactttcggcggagggaccaaggtggagatacaaaacgactgtgctgcaccatctgtcttcatctcccgctatctgatacgtcgtatctgagcgggctggacaggcncagtgnnnnnnnn

SEQ ID NO: 107601 - DNA, 714 bp, Homo sapiens
  misc_feature: GYAE6OF01C65WW.12.1.A01.1.454.CMB.1.raw
tcagatacgacgtacacgaccggtgctcgatttagacgtctcatcagggggcaggagtcagtctcagtcaggacacagcatggacatgacgggtccccgctcagctccgtggggcctcctgctactcgtggcctccggaggtcgccagatgtgacatccagatcgacccagtcctcactccctcctgtctgcatctgagcagacagatccaccatcacgttcggccgggacaagtcaacgaccatcagcagtacttaatttaagtgtatcagcaacgaaacgaacgggaacctacccgtaggtcctagtatactatgctgactactaccgttaggttcgaaccgtaaggttccgggtaccctaacgttacggtaaaggttctagggtcgtacggtgggtttacgggtcggtagggaactagttaccgtttaccaccgttccctaaccaccgtactaccgtacgctaacggtccctacgtaaccgtaaccgtaggaacttacttcgtcgtaaccttaactttaacttaccgtaacgtaaccgtaacgtaacgtaaaccgttaaccgttaccccgtttaaaccccccgttccgtttaacccggggtaccggggtaccgggtaaaccggggtaaccgtaagggggtacgggaaacttaaacccgtaaggtaaaacccgttaacggttaggtccggtaacctcgtaccccgttaaacg

SEQ ID NO: 107602 - DNA, 732 bp, Homo sapiens
  misc_feature: GYAE6OF01EBR41.12.1.A01.1.454.CMB.1.raw
  modified_base (535)..(535): a, c, t, g, unknown or other
  misc_feature (535)..(535): n is a, c, g, or t
  modified_base (715)..(715): a, c, t, g, unknown or other
  misc_feature (715)..(715): n is a, c, g, or t
tcagatacgacgtacacgaccggtgctcgatttagacgtctcatcaggggagtctcagtcaggacacagcatggacatggagggtccccgctcagctcctggggctcctgctactctgtctccgaggtgccagatgtgacatccagatcgacccagtcctccacttccctccctgtctgactatcgtagtacgcaagaacgagtacgtaccaacctactacctaacgttcggacccgggactaaacggtccaacgtaacccatccgaagactaacgttactttaaattttaaaagttcggtaacttacgaacgaaccgaaaacggtaaaaccgggaacggtaaacccgtccccgttaaaggtcctacggtactacgtaatcgtactgtaccgtactcgttagttacgaacgtaagggtccgggtacctagtacggtaagtcgaggtgagtggtcggtcgtaaggactatacgttacactcctacaacgtctacgagtactacgtctacgtacctaaacgttagtaattaccgttnacgttaacttaactttacttaaccgtcttaacgaaacgtaacttaaccgtaacgtttaccccgttacccttaccggttaacggttaccggggacgtaacgggtaacgtaacgggacgtaacgtaaccgtaaaggaaaccggtgttaccggtacggacttaaccggacctaaaccggtttnttcccgttacggttacc

SEQ ID NO: 107603 - DNA, 628 bp, Homo sapiens
  misc_feature: GYAE6OF01BJMXQ.12.1.A01.1.454.CMB.1.raw
tcagatacgacgtacacgaccggtgctcgatttagacgtctcatcaagggaaggaagggggcaggagtcagtctcagtcaggtcacagcatggacatgagggtccccgctcagctcctggggctcctgctactctggctccgaggtgccagatgtgacatccagctgacccagtctccatcctcctgtctgcatctgtaggagacaaagtcaccatcacgttgccgggctaacgagagtattcgaccaacgttatttaaatggtatacaaacaaaagcaaggacaaagtcccaaagctacctgtatttatgctcgaccacagtctgactaagggtcggttccgtacgtaaggttccacgtcgggccgtaggactacgaacggggtaactaaggtaaactttacgtactaccaacctactacgacgttagtacctaacgacgtaccttaggaaagtagttacttagtaccttaactttacttacgtagtacgtagacgtaagtacgttacccgacgtccttaccctatacctacgtttccgggaacccgaacgggtaccaccggtaccgcgtaaggtacgttacgggaacgtaacgttcggtacggtactaggacctacgtacgttccg

SEQ ID NO: 107604 - DNA, 778 bp, Homo sapiens
  misc_feature: GYAE6OF01CH2SC.12.1.A01.1.454.CMB.1.raw
  modified_base (284)..(284): a, c, t, g, unknown or other
  misc_feature (284)..(284): n is a, c, g, or t
tcagatacgacgtacacgaccggtgctcgatttagacgtctcatcagggggcaggagtcagtctcagtcaggacacagcatggacatgaggtccccgctcagctcctggggctcctgctactctggctccgaggtgccagatgtgacatccagatgacccagtctccatcctccctgtctgcatctgtagcagacagagtacacctatcacgttggccgggacaacgtcagaccatcagcagtacttaatttaacttggtatcagcaagaaacgaagggaaccncccgtaagtcctagattactatgtctgactacgtacctaggtttacgacgtaacggttccgggtaccctaagtaccgtaaagggttccgaaggtcggacgtacgggttcgggtacgtacggggtactagtttacgtttaccctacgttaaccttaccaaccgttagaccgtaaccggtacgtaacgttccttaccggtaacccgttaaacccgttaggtaaaaccgggtttcttttacccgggtaggttaaaccccctttaaatttttaacgtttaaccctaacgttaacctaaacggttaacgaaaccgtttaaaccctacccgggttttaaaccccccttcccggtttaaccgggttttacccggggaaacccggggtaacgggtaaaccccggtaagggggttaaaccggtaacggtaaacccgtaaaccgggttaaaacccggtacggtttaacgggtccgtaacccggttggaaaccccctttaacggg

SEQ ID NO: 107605 - DNA, 291 bp, Homo sapiens
  misc_feature: GYAE6OF01ET49T.12.1.A01.1.454.CMB.1.raw
  modified_base (263)..(263): a, c, t, g, unknown or other
  misc_feature (263)..(263): n is a, c, g, or t
  modified_base (281)..(291): a, c, t, g, unknown or other
  misc_feature (281)..(291): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcacatctgtcttcatccttccgcatctagatacgtctatctgagcggntggacaaggcacagtagnnnnnnnnnnn

SEQ ID NO: 107606 - DNA, 287 bp, Homo sapiens
  misc_feature: GYAE6OF01AOUPG.12.1.A01.1.454.CMB.1.raw
  modified_base (280)..(287): a, c, t, g, unknown or other
  misc_feature (280)..(287): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcacttattactgtcaacagagtaacagttaccctcccactttcggcggagggaccaaggtggagatcaaacgaactgtggctgcaccatctgtcttcatccttccgccatctgatacgtcgtatctgagcgggctggcaaggcgcatgnnnnnnnn

SEQ ID NO: 107607 - DNA, 285 bp, Homo sapiens
  misc_feature: GYAE6OF01A6QPZ.12.1.A01.1.454.CMB.1.raw
  modified_base (273)..(273): a, c, t, g, unknown or other
  misc_feature (273)..(273): n is a, c, g, or t
  modified_base (279)..(280): a, c, t, g, unknown or other
  misc_feature (279)..(280): n is a, c, g, or t
  modified_base (282)..(285): a, c, t, g, unknown or other
  misc_feature (282)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctccactttcggcggagggaccaaggtggagatcaaacgaactgtggctgcaccatctgtcttcatccttcccgcatctgatacgtcgtatctgagcggctggcaggcncatagnngnnnn

SEQ ID NO: 107608 - DNA, 681 bp, Homo sapiens
  misc_feature: GYAE6OF01EX4QI.12.1.A01.1.454.CMB.1.raw
  modified_base (299)..(299): a, c, t, g, unknown or other
  misc_feature (299)..(299): n is a, c, g, or t
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtacgcagacagacgtcaccatccacgttgccggcaagtcagaccatcagcagactaatttaaatggtaatcagcaagaaaacccgaggggaaactacccccgaacggtaccgtacgtacntactagtcgtcgtcgtactacgtaccgttagttacgaacgtaacgggtaccggtacctacgtaacgtaacggttacgtaggtacggacgtacggtcgggtcggtacggtacgtacgttacttacctactacctacctacctacgtacgacgacgtacgtcgtacgtaccgtaacgtagtaacgtacttacgtacgtaacttaactttaacttacgtacgtaacgtaacgtaacgtaacgtaaccgttaacccgttaaccccgtacccgttaccggttaccgggtaaccgggtaccgggtaaccggtaacgggtacggtaagtaacgtaaccggaaaccggtaacggtacggtacggtacgtacgtacctaccgtacgttacg

SEQ ID NO: 107609 - DNA, 289 bp, Homo sapiens
  misc_feature: GYAE6OF01CG990.12.1.A01.1.454.CMB.1.raw
  modified_base (282)..(289): a, c, t, g, unknown or other
  misc_feature (282)..(289): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgactgtggctgcaccatctgtcttcatccttcccgcatctgatacgtcgtatcgtgagcgggctggcaaggcgcatagnnnnnnnn

SEQ ID NO: 107610 - DNA, 351 bp, Homo sapiens
  misc_feature: GYAE6OF01BLYVX.12.1.A01.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (306)..(351): a, c, t, g, unknown or other
  misc_feature (306)..(351): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacacgttaccctccacgtttcggcggacggaccaggtgganatacaaacgactgtggctgcactatctgtctcactcctccgcactntgtattaccggtctatcgngacggcggtcgtggacgaaggtccatanacgncnantncgntgnnnnnnnnnnnnnnnnnnnnnnnnnnnnnnnnnnnnnnnnnnnnnn

SEQ ID NO: 107611 - DNA, 285 bp, Homo sapiens
  misc_feature: GYAE6OF01ADKZ1.12.1.A01.1.454.CMB.1.raw
  modified_base (265)..(265): a, c, t, g, unknown or other
  misc_feature (265)..(265): n is a, c, g, or t
  modified_base (281)..(285): a, c, t, g, unknown or other
  misc_feature (281)..(285): n is a, c, g, or t
tcagatacgacgtacacgaccggtgctcgatttagacgtctcatcagggatagaagttattcagcaggcacacaacagaggcagttccagatttcaactgctcatcagcagtctgcaacctgaagattctgcaacttattactgtcaacagagtaacagttaccctcccactttcggcggagggaccaaggtggagatcaaacgaactgtggctgcaccatctgtcttcatcttcccgcatctgatacgtcgtatctgagcgggntggcaaggcgcatagnnnnn

SEQ ID NO: 107612 - DNA, 720 bp, Homo sapiens
  misc_feature: GYAE6OF01AY681.12.1.A01.1.454.CMB.1.raw
  modified_base (222)..(222): a, c, t, g, unknown or other
  misc_feature (222)..(222): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtcctccatccctccctgtctgcatctgtagcagacagagtcaccatcacttggccgganaagtcagaccatcagcagacttaatttaaagtggtatacagacaacgaaaccagggtaacacccctaaggtcctgatctatgctgctagtcctagtttcgacgtaaaggtcgggtacccagtaccgtaaggttcgaggtcggcgagggttcgggtacgtagggactacgttacgtttcctaaccttcgtaccctaactactacgaacgtccgtaacgttccgtacggtaaccctaaccgttacggtaaacgttaccgtttacgttacgtaaccttttaaaccttttaacgtttaaccgttacgtaacgtaaaccgtaaggttaaaccgttaaacccgtttaacccgtttacccccgttaccccgttaacggttttaccggggaacccgggggttaaccggaacccgggttaaggggttacggaaaccggttaacgttaaacccggaaaacgttacggttacgggttaacggtaccggttaccgaacccgttaaacccg

SEQ ID NO: 107613 - DNA, 612 bp, Homo sapiens
  misc_feature: GYAE6OF01EU5AD.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcacatcacttggccggcaagtcagaccatcagcagctatttaaatggtatcagcagaaaccagggaaacgcccctaaggcctgatcttagtgctgctatccaagtttgccaaaggttcgggacctatagtaaggttcagtgggtacagggtggtcgtagggtacagtagtttacacgtctccaactatcgacgctagtactgctaaaccctgaagtacttctagtacctaaacgtttactaactcgtaactaaactaggtaaccgttaacctaaccgttttaacccccgtccccgtaacgggttttacccgggacggtaacggggtaacccgtaaaagggtgggtaaaccgaagttacggaaaaaccggtacgttaggtaccgggtacttacgacccgtaaacctcgttccgtttaaccg

SEQ ID NO: 107614 - DNA, 750 bp, Homo sapiens
  misc_feature: GYAE6OF01EQDKD.12.1.A01.1.454.CMB.1.raw
tcagatacgacgtacacgaccggtgctcgatttagacgtctcatcaggggggcaggagtcagtctcagtcaggacacagcatggacatgagggtccccgctcagctcctggggctcctgctactctggctccgaggtgccagatgtgacatccagatgacccagtctccatccctcctgtctgcatcgtgtagcagaacagagtcaccatcacttggccgggcaagtcaagaccatcagcagctatttaaattggtatcagacaacgtaaaccgaagggaaacgaccccgttaacggtacctacggtactctaatcgtcttagactacttccgtaacgttttacgacgtaaacggtcgggtaccctaacgtacgtaacgggttacgtaggtcggcgtacgggtgggtacggtagggaacgtagtaactttaccgtaaccttacctaccgtaaccctaacgttaccaacggtaccgtacgggttacctaccgtaacccgtaaacccgttaagtaaacggtaacttttaccgtacgttaaccttaaacgtttaactttaacttacggtaaccgtaaaccgtaaagtaacggtttaaaccgtaacccgtttaaccccgttacccgttaaccggttttcccgggaaccggggtaaacggggaaccggttaaacggggtaacgggtaacgggtaaactaaacccggaaaacggttaaacttagggttaacgccggttaacggaccttaaacccgg

SEQ ID NO: 107615 - DNA, 626 bp, Homo sapiens
  misc_feature: GYAE6OF01C41S3.12.1.A01.1.454.CMB.1.raw
  modified_base (319)..(319): a, c, t, g, unknown or other
  misc_feature (319)..(319): n is a, c, g, or t
  modified_base (423)..(423): a, c, t, g, unknown or other
  misc_feature (423)..(423): n is a, c, g, or t
tcagatacgacgtacacgaccggtgctcgatttagacgtctcatcaaggaagggaagggggcaggagtcagtctcagtcaggtcacagcatggacatgagggtccccgctcagctccgtggggctcctgctactctggctccgaggtgccagatgtgacatccagctcgacccagtcctccactccctccctgtctgcatctgtagagacaagtcacatcactcggccggactaagagagtattcgcctaacgttatttaaattggaatacaaaacaaaagcaaggacaaacgtacccaaagtcctactagtatttacngcctcgcccactagtctcggacgtaacgggttcgggttacccgtacgttaacggttccaacggtcggtaccgtaggactacggaagggactaagtaactttacnctaccacatcagttactactacgacgtcctaagtaagtattacgttctacctttaacgtactttactgttaccagtacgaacgttaccgttacccgtcgtacccctcctacgttacctaccgtttaccggacccgtaaacgggccaaccggacccgacgagtacgttccggaaacgtacgtggtcggctacggacacgtctcg

SEQ ID NO: 107616 - DNA, 300 bp, Homo sapiens
  misc_feature: GYAE6OF01CASI7.12.1.A01.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (282)..(286): a, c, t, g, unknown or other
  misc_feature (282)..(286): n is a, c, g, or t
  modified_base (289)..(300): a, c, t, g, unknown or other
  misc_feature (289)..(300): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtctcatctttccgcatcngatacgtcgtatctgagcggctggcaaggcgcatagntnnnnncgnnnnnnnnnnnn

SEQ ID NO: 107617 - DNA, 282 bp, Homo sapiens
  misc_feature: GYAE6OF01ADIH9.12.1.A01.1.454.CMB.1.raw
  modified_base (274)..(274): a, c, t, g, unknown or other
  misc_feature (274)..(274): n is a, c, g, or t
  modified_base (278)..(282): a, c, t, g, unknown or other
  misc_feature (278)..(282): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggaggaccaaggtgagatcaaacgactgtggctgcaccatctgtcttcatccttcccgcatctgatacgtcgtatcgtgagcgggctggcaggcnatgnnnnn

SEQ ID NO: 107618 - DNA, 759 bp, Homo sapiens
  misc_feature: GYAE6OF01DI5JV.12.1.A01.1.454.CMB.1.raw
  modified_base (319)..(319): a, c, t, g, unknown or other
  misc_feature (319)..(319): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatcgacccagtcctccatccctccctgtcctgactatctgtagcagacagatcaccatcacttcggccggacaagtcacgaccatcagcagtacttaatttaagttggtactacgagacaaaggaaaacccgagggaaacctaccccgtaaggtcctagatctancgctgcatccgtagttcgacgtaacggtcggtacctagtacgtaaggtcgaggtggacgtagggttcgggtacgttacggggaactaggtttactttaccgacttacccaccgtaacctataccgacgtaccgtagttccgtacaaccgttaaaccgtaggtaaactttcgtttacgtacgtaacctttaaacgttttcgttaaaccgttacggtaaaccctaaacggttaacggttaaaccgtttaaaccccggttaacccgtttacccccccgtttaccggtttaacccgggttacccggggggaaaccgggtaaacccggggtaaacggttaaggggggttaaacgggaaaccgttaaaccgggtaaaacccggtaaaaccggggtttacgtacgggggggttacttaccccggtaaggaaccccgtttaaacccgg

SEQ ID NO: 107619 - DNA, 287 bp, Homo sapiens
  misc_feature: GYAE6OF01DG0SQ.12.1.A01.1.454.CMB.1.raw
  modified_base (263)..(263): a, c, t, g, unknown or other
  misc_feature (263)..(263): n is a, c, g, or t
  modified_base (279)..(287): a, c, t, g, unknown or other
  misc_feature (279)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgcatctgatacgtcgtactgagcggntggcaaggcgcatagnnnnnnnnn

SEQ ID NO: 107620 - DNA, 778 bp, Homo sapiens
  misc_feature: GYAE6OF01DE2OG.12.1.A01.1.454.CMB.1.raw
tcagatacgacgtacacgaccggtgctcgatttagacgtctcatcagggggagtctcagtcaggacacagcatggacatgagggtccccgctcagctcctggggctcctgctactctggctccgaggtgccagatgtgacatccagatgacccagtctccatcctcctgtctgcatctgtagcagacagagtcaccatcacgttgccggcaagtcagaccatcagcagtctaatttaatggtatcagacaagaaaccgaggaaacgccccgtaaggtcctagatctatgactcgactactaccgtaggtttacgaacgtaaaacggttcggggtacccaagttccggtaaaggttcgaaggtcgggtacgtaagggttcggggtcgttacggggaacgtaaggtaactttacctaaccgttaccttaccaaactaaaccttaccgaaaccgtacgtaccccttaggaccctaacggtacccgtaggttaacgtttaacgttttttaccggaacctttaaaccgttttaacgttttaacctacggtttaaccgtaaaaccggttttaacgggttttttaaacctttaaacccgtttttttaacccccgttagggtttttaacccgttttaccccggggttaacccccggtttagggggaaaccccttaaccggtaaagggttaaactaacgttaaacgtaaacccgtaaaaacggtacgttaggtccgggtaacttacggtaccaaacccttagtttaccgttcggttcctttaacccg

SEQ ID NO: 107621 - DNA, 633 bp, Homo sapiens
  misc_feature: GYAE6OF01CTF3J.12.1.A01.1.454.CMB.1.raw
tcagatacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctcctgtctgcatctgtagcagacagagtcaaccatcacgttggaccgggacaagtcagaccatcagcagtctaatttaagtgtactcgacgacaagaaaccgagggaaacgtcccgtaaggtcctaggtactacgtatcgctcggctactacgtagttacgacgtaaggtccgggtaccagtacgaagttacgtagtcggagtacggtgggtcgtaggggactaggtactttacaacgttcgtaccaacgtaactcacggactacggtactcgaacaaacgtgtaagtacttcgtacgtactaagtttactactacgtactaaagtacgtaacgtaaaccgttccgttaacccctacgttacggtttacgggacggtaaggtaacccggtagggtacgaacggtaacgaaacgttaaaacgcggttacggtacggtacctacggtactacctacggtccttgttaacccg

SEQ ID NO: 107622 - DNA, 287 bp, Homo sapiens
  misc_feature: GYAE6OF01A75IG.12.1.A01.1.454.CMB.1.raw
  modified_base (279)..(287): a, c, t, g, unknown or other
  misc_feature (279)..(287): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatctccgcatctgatacgtcgtatctgagcggctggcaaggcgcatagnnnnnnnnn

SEQ ID NO: 107623 - DNA, 605 bp, Homo sapiens
  misc_feature: GYAE6OF01EM18S.12.1.A01.1.454.CMB.1.raw
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagatacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatcgacccagtctccatcctccctgtctgcatctgtacgcagacagtacgtcacctatcacgttgccgganaagtcagaccatcagcagtacttaatttaatgatcgagacacgaaacgaggaacncccgtaaggtcctgactctagtgctgacacttcctagttacgacgtaacggtcggtacccagtaccgtaaggttcgaaggtcggagtacgggtggttaccgtagggactaggttactttcaaccgttctaccaccgtattaccgagctaggtttccacggtacctaacgttggaaacttcgttacacgtactttaacttacgttacttacgaaccgagttaacgtaacgtacccttaccgttacccctaccgttcggttacgggaccggaacggtaccgtaaggtacgacgtaactaacgaacgtagtcgcgacgtcgactaccg

SEQ ID NO: 107624 - DNA, 285 bp, Homo sapiens
  misc_feature: GYAE6OF01D019A.12.1.A01.1.454.CMB.1.raw
  modified_base (280)..(285): a, c, t, g, unknown or other
  misc_feature (280)..(285): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgcaacttattactgtcaacagagtaacagttaccctcccactttcggcggagggaccaaggtggagatcaaacgaactgtggctgcaccatctgtctcatcttccgcatctgatacgtcgtatctggagcggctggcaaggcgcatagnnnnnn

SEQ ID NO: 107625 - DNA, 373 bp, Homo sapiens
  misc_feature: GYAE6OF01EOLZO.12.1.A01.1.454.CMB.1.raw
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (309)..(373): a, c, t, g, unknown or other
  misc_feature (309)..(373): n is a, c, g, or t
tcagatacgacgtacacgaccggtgctcgatttagacgtctcatcagggatagaagttattcagcaggcacacaacagaggcagttccagatttcactctcaccatcagcagtctgcaacctgaagattctgctaactttattactgtcaacagagtaacagttaccctcccactttcgggcggagggaccaaggtggagatcaaaacgactgtgctgcaccatctgtcttcacttcttcccgctatctgtaacttacggtctatcctggacggcgggctaggcgaaggcgactagtaggnancagncnnnnnnnnnnnnnnnnnnnnnnnnnnnnnnnnnnnnnnnnnnnnnnnnnnnnnnnnnnnnnnnnn

SEQ ID NO: 107626 - DNA, 992 bp, Homo sapiens
  misc_feature: GYAE6OF01DA9N9.12.1.A01.1.454.CMB.1.raw
  modified_base (110)..(110): a, c, t, g, unknown or other
  misc_feature (110)..(110): n is a, c, g, or t
tcagatacgacgtacacgaccggtgctcgatttagacgtctcatcaagggaagggaagggggcaggagtcagtctcagtcaggtcacagcatggacatgacgggtccccnctcagctccgtggggctcctgctactctcggcctaccggaggtcgccagtatgtagacactccagctcgaccctagtcctccacttccctccctgtctcgctatcgtggtaacggagaacaagtacacatacctacgttcggacccgggaactaacggaagtacgttaacgttaccgaacccgttaaagtttaacttttaaaaagttggttaaacctaaacgaaaaaacgaaaaaggccgaaaaggtaacctaaaaacggacccctaaaaggtccttaccgttaaggttaattttacgacggtacctaccggaccctaaaccgttaggtcgtacggaacgggttaacggggttttccgggttacccgtaacggtaaacggttcccgtaacgggttcgggtcggtaacgggtaacgtaccggaaacgggggtaaactttaaacggttaaaccgtttttaccaccctaacccgtaacgtaacggtttactaaagggttaaaccgttaccgtaaacgaacggtaccgttaaaaggtaaaccgttatttaacgtttaccggttaaccttttaacgttttaaccgtttaacccgttcgggttaaacccgaagggttaaacccgtaaacggggtttaccccggtttaaaccccgggtccccttacccggtaaacccctttaacggttaaccccggttttaaaccgggtttaccccggggaaaaccccgggaaaggggttaaaccccccgaaaccccgggtaacccggggtaaccttaaaaggggtacccgggttttaaaacccgggaaaccggttaacggtttacgggggtacccgttaaacccggcccgggttaaaacccctaaccggttaccgtttttaaacccgg

SEQ ID NO: 107627 - DNA, 711 bp, Homo sapiens
  misc_feature: GYAE6OF01BLATD.12.1.A01.1.454.CMB.1.raw
  modified_base (340)..(340): a, c, t, g, unknown or other
  misc_feature (340)..(340): n is a, c, g, or t
tcagatacgacgtacacgaccggtgctcgatttagacgtctcatcaggggagtcgtcagtccaggactacagctatggacatgagggtccccgctcagctcctggggctcctgctacgtctggctccgaggtgccagtatggtgactattaccagatcgacccagtctccatccctcctgtctgctatcgtgtacgcgagacgaggtacggtccaaccatcctacgttcggccgggacaagtcacgtaccagtcagtcagtacttaagtttaagttggtactcagacaacggaaaccgagggaaaccgtccccgtaaggtcctagtacgtacgtagtcgngtacgctacgtctagttacgacgtaacgggtcgggtacccagtacgtaagttcaggtcggagtaggtcgggtactaggactagtacgttaccgacgtcctaccgtaacctagtaccgaagtaccgtaacgttaccgactaacctaaaccgtagtaacgttcttcgtacgtaaccttaactttacgtaccgtaccgtaagtaaaccggtaagttaaccggtaaacccgttacccgtttaccccgtacccgttaacggttcccgggaacgggtaaccggtaccgtaagggtaacgaacgtaacccgtaagaaacgttcgggtcggttacgaccgtacgttaccgtaaccttcggttacgttcggttaaccccg
